(12) United States Patent
Shimkets et al.

(10) Patent No.: US 6,670,464 B1
(45) Date of Patent: Dec. 30, 2003

(54) NUCLEIC ACIDS CONTAINING SINGLE NUCLEOTIDE POLYMORPHISMS AND METHODS OF USE THEREOF

(75) Inventors: Richard A. Shimkets, West Haven, CT (US); Martin Leach, Webster, MA (US)

(73) Assignee: Curagen Corporation, New Haven, CT (US)

( * ) Notice: Subject to any disclaimer, the term of this patent is extended or adjusted under 35 U.S.C. 154(b) by 0 days.

(21) Appl. No.: 09/443,199

(22) Filed: Nov. 16, 1999

Related U.S. Application Data
(60) Provisional application No. 60/109,024, filed on Nov. 17, 1998.

(51) Int. Cl.[7] .................... C07H 21/04; C07H 21/02; C12Q 1/68; A61K 38/00
(52) U.S. Cl. ................ 536/23.5; 435/6; 530/300; 536/23.1; 536/24.3; 536/24.5
(58) Field of Search .................. 435/6; 536/23.1, 536/23.5, 24.3, 24.5

(56) References Cited

U.S. PATENT DOCUMENTS 5,856,104 A    1/1999   Chee et al.

FOREIGN PATENT DOCUMENTS

| EP | 717113 A2 | 6/1996 |
|---|---|---|
| EP | 0 785 280 A2 | 7/1997 |
| WO | WO 93/22456 | 11/1993 |
| WO | WO 95/11995 | 5/1995 |
| WO | WO 97/29212 | 8/1997 |
| WO | WO 98/14466 | 4/1998 |
| WO | WO 98/14470 | 4/1998 |
| WO | WO 98/18967 | 5/1998 |
| WO | WO 98/20165 | 5/1998 |
| WO | WO 98/21316 | 5/1998 |
| WO | WO 98/30717 | 7/1998 |
| WO | WO 98/38846 | 9/1998 |
| WO | WO 98/56954 | 12/1998 |

OTHER PUBLICATIONS

Iyers et al., "Quod erat demonstradum? The mystery of experimental validation of apparently erroneous computational analysis of protein sequences," Genome Biology, 2001, vol. 2, No. 12, pp. 1–11.*
Accession No. Z50788 on GenBank Database, Bensch et al., Oct. 24, 1995.*
Accession No. AA918951 on GenBank Database, NCI–CGAP, Jun. 10, 1998.*
Sulston et al., "Toward a complete human genome sequence," Genome Research, Nov. 1998, vol. 8, No. 11, pp. 1097–1108.*
Abravaya, K., J. J. Carrino, et al. (1995). "Detection of point mutations with a modified ligase chain reaction (Gap–LCR)." Nucleic Acids Res 23(4): 675–82.

Adams, M. D., J. M. Kelley, et al. (1991). "Complementary DNA sequencing: expressed sequence tags and human genome project." Science 252(5013): 1651–6.
Barany, F. (1991). "Genetic disease detection and DNA amplification using cloned thermostable ligase." Proc Natl Acad Sci U S A 88(1): 189–93.
Cotton, R. G., N. R. Rodrigues, et al. (1988). "Reactivity of cytosine and thymine in single–base–pair mismatches with hydroxylamine and osmium tetroxide and its application to the study of mutations." Proc Natl Acad Sci U S A 85(12): 4397–401.
Evans, W. E. and M. V. Relling (1999). "Pharmacogenomics: translating functional genomics into rational therapeutics." Science 286(5439): 487–91.
Faham, M. and D. R. Cox (1995). "A novel in vivo method to detect DNA sequence variation." Genome Res 5(5): 474–82.
Fischer, S. G. and L. S. Lerman (1983). "DNA fragments differing by single base–pair substitutions are separated in denaturing gradient gels: correspondence with melting theory." Proc Natl Acad Sci U S A 80(6): 1579–83.
Gibbs, R. A., P. N. Nguyen, et al. (1989). "Detection of single DNA base differences by competitive oligonucleotide priming." Nucleic Acids Res 17(7): 2437–48.
Kren, B. T., B. Parashar, et al. (1999). "Correction of the UDP–glucuronosyltransferase gene defect in the gunn rat model of crigler–najjar syndrome type I with a chimeric oliogonucleotide." Proc Natl Acad Sci U S A 96(18): 10349–54.
Landegren, U., R. Kaiser, et al. (1988). "A ligase–mediated gene detection technique." Science 241(4869): 1077–80.
Maskos, U. and E. M. Southern (1993). "A novel method for the parallel analysis of multiple mutations in multiple samples." Nucleic Acids Res 21(9): 2269–70.
Myers, R. M., Z. Larin, et al. (1985). "Detection of single base substitutions by ribonuclease cleavage at mismatches in RNA:DNA duplexes." Science 230(4731): 1242–6.
Newton, C. R., A. Graham, et al. (1989). "Analysis of any point mutation in DNA. The amplification refractory mutation system (ARMS)." Nucleic Acids Res 17(7): 2503–16.
Nikiforov, T. T., R. B. Rendle, et al. (1994). "Genetic Bit Analysis: a solid phase method for typing single nucleotide polymorphisms." Nucleic Acids Res 22(20): 4167–75.
Orita, M., Y. Suzuki, et al. (1989). "Rapid and sensitive detection of point mutations and DNA polymorphisms using the polymerase chain reaction." Genomics 5(4): 874–9.
Orita, M., H. Iwahana, et al. (1989). "Detection of polymorphisms of human DNA by gel electrophoresis as single–strand conformation polymorphisms." Proc Natl Acad Sci U S A 86(8): 2766–70.

(List continued on next page.)

Primary Examiner—Kenneth R. Horlick
Assistant Examiner—Young Kim
(74) Attorney, Agent, or Firm—Ivor R. Elrifi; Cynthia A. Kozakiewicz; Mintz, Levin, Cohn, Ferris, Glovsky and Popeo, P.C.

(57) ABSTRACT

The invention provides nucleic acids containing single-nucleotide polymorphisms identified for transcribed human sequences, as well as methods of using the nucleic acids.

28 Claims, No Drawings

OTHER PUBLICATIONS

Orum, H., P. E. Nielsen, et al. (1993). "Single base pair mutation analysis by PNA directed PCR clamping." *Nucleic Acids Res* 21(23): 5332–6.

Rhodes, M., R. Straw, et al. (1998). "A high–resolution microsatellite map of the mouse genome." *Genome Res* 8(5): 531–42.

Saiki, R. K., P. S. Walsh, et al. (1989). "Genetic analysis of amplified DNA with immobilized sequence–specific oligonucleotide probes." *Proc Natl Acad Sci U S A* 86(16): 6230–4.

Syvanen, A. C., K. Aalto–Setala, et al. (1990). "A primer–guided nucleotide incorporation assay in the genotyping of apolipoprotein E." *Genomics* 8(4): 684–92.

Taillon–Miller, P., Z. Gu, et al. (1998). "Overlapping genomic sequences: A treasure trove of single–nucleotide polymorphisms [In Process Citation]." *Genome Res* 8(7): 748–54.

Thiede, C., E. Bayerdorffer, et al. (1996). "Simple and sensitive detection of mutations in the ras proto–oncogenes using PNA–mediated PCR clamping." *Nucleic Acids Res* 24(5): 983–4.

Wagner, R., P. Debbie, et al. (1995). "Mutation detection using immobilized mismatch binding protein (MutS)." *Nucleic Acids Res* 23(19): 3944–8.

Wallace, R. B., J. Shaffer, et al. (1979). "Hybridization of synthetic oligodeoxyribonucleotides to phi chi 174 DNA: the effect of single base pair mismatch." *Nucleic Acids Res* 6(11): 3543–57.

Youil, R., B. W. Kemper, et al. (1995). "Screening for mutations by enzyme mismatch cleavage with T4 endonuclease VII." *Proc Natl Acad Sci U S A* 92(1): 87–91.

Xiong and Jin (1997). "Biallelic markers in genetics studies of human diseases: Their power, accuracy, and density in population–based linkage analysis." American Journal of Human Genetics 61(4) suppl.:1759.

Fan et al. (1997). "Genetic mapping: Finding and analyzing single–nucleotide polymorphisms with high–density DNA arrays. "American Journal of Human Genetics 61(4) suppl.: 1601.

Wang et al. (1998). "Large–scale identification, mapping, and genotyping of single–nucleotide polymorphisms in the human genome." Science 280:1077–1082.

International Search Report for PCT/US 99/27293. Mailed on Dec. 21, 2000.

* cited by examiner

NUCLEIC ACIDS CONTAINING SINGLE NUCLEOTIDE POLYMORPHISMS AND METHODS OF USE THEREOF

RELATED APPLICATIONS

This application claims the benefit of the U.S. Provisional Application No. 60/109,024, filed Nov. 17, 1998 which is incorporated herein by reference in its entirety.

BACKGROUND OF THE INVENTION

Sequence polymorphism-based analysis of nucleic acid sequences has lead to novel approaches for determining the identity and relatedness of individuals. The approach is generally based on alterations in nucleic acid sequences between related individuals. This analysis has been widely used in a variety of genetic, diagnostic, and forensic applications. For example, polymorphism analyses are used in identity and paternity analysis, and in genetic mapping studies.

Several different types of polymorphisms in nucleic acid have been described. One such type of variation is a restriction fragment length polymorphism (RFLP). RFLPS can create or delete a recognition sequence for a restriction endonuclease in one nucleic acid relative to a second nucleic acid. The result of the variation is in an alteration the relative length of restriction enzyme generated DNA fragments in the two nucleic acids.

Other polymorphisms take the form of short tandem repeats (STR) sequences, which are also referred to as variable numbers of tandem repeat (VNTR) sequences. STR sequences typically that include tandem repeats of 2, 3, or 4 nucleotide sequences that are present in a nucleic acid from one individual but absent from a second, related individual at the corresponding genomic location.

Other polymorphisms take the form of single nucleotide variations, termed single nucleotide polymorphisms (SNPs), between individuals. A SNP can, in some instances, be referred to as a "cSNP" to denote that the nucleotide sequence containing the SNP originates as a cDNA.

SNPs can arise in several ways. A single nucleotide polymorphism may arise due to a substitution of one nucleotide for another at the polymorphic site. Substitutions can be transitions or transversions. A transition is the replacement of one purine nucleotide by another purine nucleotide, or one pyrimidine by another pyrimidine. A transversion is the replacement of a purine by a pyrimidine, or the converse.

Single nucleotide polymorphisms can also arise from a deletion of a nucleotide or an insertion of a nucleotide relative to a reference allele. Thus, the polymorphic site is a site at which one allele bears a gap with respect to a single nucleotide in another allele. Some SNPs occur within, or near genes. One such class includes SNPs falling within regions of genes encoding for a polypeptide product. These SNPs may result in an alteration of the amino acid sequence of the polypeptide product and give rise to the expression of a defective or other variant protein. Such variant products can, in some cases result in a pathological condition, e.g., genetic disease. Examples of genes in which a polymorphism within a coding sequence gives rise to genetic disease include sickle cell anemia and cystic fibrosis. Other SNPs do not result in alteration of the polypeptide product. Of course, SNPs can also occur in noncoding regions of genes.

SNPs tend to occur with great frequency and are spaced uniformly throughout the genome. The frequency and uniformity of SNPs means that there is a greater probability that such a polymorphism will be found in close proximity to a genetic locus of interest.

SUMMARY OF THE INVENTION

The invention is based in part on the discovery of novel single nucleotide polymorphisms (SNPs) in regions of human DNA.

Accordingly, in one aspect, the invention provides an isolated polynucleotide which includes one or more of the SNPs described herein. The polynucleotide can be, e.g., a nucleotide sequence which includes one or more of the polymorphic sequences shown in Table 1 (SEQ ID NOS: 1–1192) and which includes a polymorphic sequence, or a fragment of the polymorphic sequence, as long as it includes the polymorphic site. The polynucleotide may alternatively contain a nucleotide sequence which includes a sequence complementary to one or more of the sequences (SEQ ID NOS: 1–1192), or a fragment of the complementary nucleotide sequence, provided that the fragment includes a polymorphic site in the polymorphic sequence.

The polynucleotide can be, e.g., DNA or RNA, and can be between about 10 and about 100 nucleotides, e.g, 10–90, 10–75, 10–51, 10–40, or 10–30, nucleotides in length.

In some embodiments, the polymorphic site in the polymorphic sequence includes a nucleotide other than the nucleotide listed in Table 1, column 5 for the polymorphic sequence, e.g., the polymorphic site includes the nucleotide listed in Table 1, column 6 for the polymorphic sequence.

In other embodiments, the complement of the polymorphic site includes a nucleotide other than the complement of the nucleotide listed in Table 1, column 5 for the complement of the polymorphic sequence, e.g., the complement of the nucleotide listed in Table 1, column 6 for the polymorphic sequence.

In some embodiments, the polymorphic sequence is associated with a polypeptide related to one of the protein families disclosed herein. For example, the nucleic acid may be associated with a polypeptide related to angiopoietin, 4-hydroxybutyrate dehydrogenase, or any of the other proteins identified in Table 1, column 10.

In another aspect, the invention provides an isolated allele-specific oligonucleotide that hybridizes to a first polynucleotide containing a polymorphic site. The first polynucleotide can be, e.g., a nucleotide sequence comprising one or more polymorphic sequences (SEQ ID NOS:1–1192), provided that the polymorphic sequence includes a nucleotide other than the nucleotide recited in Table 1, column 5 for the polymorphic sequence. Alternatively, the first polynucleotide can be a nucleotide sequence that is a fragment of the polymorphic sequence, provided that the fragment includes a polymorphic site in the polymorphic sequence, or a complementary nucleotide sequence which includes a sequence complementary to one or more polymorphic sequences (SEQ ID NOS:1–1192), provided that the complementary nucleotide sequence includes a nucleotide other than the complement of the nucleotide recited in Table 1, column 5. The first polynucleotide may in addition include a nucleotide sequence that is a fragment of the complementary sequence, provided that the fragment includes a polymorphic site in the polymorphic sequence.

In some embodiments, the oligonucleotide does not hybridize under stringent conditions to a second polynucleotide. The second polynucleotide can be, e.g., (a) a nucleotide sequence comprising one or more polymorphic sequences (SEQ ID NOS:1–1192), wherein the polymorphic sequence includes the nucleotide listed in Table 1, column 5 for the polymorphic sequence; (b) a nucleotide sequence that is a fragment of any of the polymorphic sequences; (c) a complementary nucleotide sequence including a sequence complementary to one or more polymorphic sequences (SEQ ID NOS:1–1192), wherein the polymorphic sequence includes the complement of the nucleotide listed in Table 1, column 5; and (d) a nucleotide sequence that is a fragment of the complementary sequence, provided that the fragment includes a polymorphic site in the polymorphic sequence.

The oligonucleotide can be, e.g., between about 10 and about 100 bases in length. In some embodiments, the oligonucleotide is between about 10 and 75 bases, 10 and 51 bases, 10 and about 40 bases, or about 15 and 30 bases in length.

The invention also provides a method of detecting a polymorphic site in a nucleic acid. The method includes contacting the nucleic acid with an oligonucleotide that hybridizes to a polymorphic sequence selected from the group consisting of SEQ ID NOS: 1–1192, or its complement, provided that the polymorphic sequence includes a nucleotide other than the nucleotide recited in Table 1, column 5 for the polymorphic sequence, or the complement includes a nucleotide other than the complement of the nucleotide recited in Table 1, column 5. The method also includes determining whether the nucleic acid and the oligonucleotide hybridize. Hybridization of the oligonucleotide to the nucleic acid sequence indicates the presence of the polymorphic site in the nucleic acid.

In preferred embodiments, the oligonucleotide does not hybridize to the polymorphic sequence when the polymorphic sequence includes the nucleotide recited in Table 1, column 5 for the polymorphic sequence, or when the complement of the polymorphic sequence includes the complement of the nucleotide recited in Table 1, column 5 for the polymorphic sequence.

The oligonucleotide can be, e.g., between about 10 and about 100 bases in length. In some embodiments, the oligonucleotide is between about 10 and 75 bases, 10 and 51 bases, 10 and about 40 bases, or about 15 and 30 bases in length.

In some embodiments, the polymorphic sequence identified by the oligonucleotide is associated with a nucleic acid encoding polypeptide related to one of the protein families disclosed herein, the polymorphic sequence is associated with a polypeptide related to one of the protein families disclosed herein. For example, the nucleic acid may be associated with a polypeptide related to angiopoietin, 4-hydroxybutyrate dehydrogenase, or any of the other proteins identified in Table 1, column 10.

In a further aspect, the invention provides a method of determining the relatedness of a first and second nucleic acid. The method includes providing a first nucleic acid and a second nucleic acid and contacting the first nucleic acid and the second nucleic acid with an oligonucleotide that hybridizes to a polymorphic sequence selected from the group consisting of SEQ ID NOS: 1–1192, or its complement, provided that the polymorphic sequence includes a nucleotide other than the nucleotide recited in Table 1, column 5 for the polymorphic sequence, or the complement includes a nucleotide other than the complement of the nucleotide recited in Table 1, column 5. The method also includes determining whether the first nucleic acid and the second nucleic acid hybridize to the oligonucleotide, and comparing hybridization of the first and second nucleic acids to the oligonucleotide. Hybridization of first and second nucleic acids to the nucleic acid indicates the first and second subjects are related.

In preferred embodiments, the oligonucleotide does not hybridize to the polymorphic sequence when the polymorphic sequence includes the nucleotide recited in Table 1, column 5 for the polymorphic sequence, or when the complement of the polymorphic sequence includes the complement of the nucleotide recited in Table 1, column 5 for the polymorphic sequence.

The oligonucleotide can be, e.g., between about 10 and about 100 bases in length. In some embodiments, the oligonucleotide is between about 10 and 75 bases, 10 and 51 bases, 10 and about 40 bases, or about 15 and 30 bases in length.

The method can be used in a variety of applications. For example, the first nucleic acid may be isolated from physical evidence gathered at a crime scene, and the second nucleic acid may be obtained is a person suspected of having committed the crime. Matching the two nucleic acids using the method can establishing whether the physical evidence originated from the person.

In another example, the first sample may be from a human male suspected of being the father of a child and the second sample may be from a child. Establishing a match using the described method can establishing whether the male is the father of the child.

In another aspect, the method includes determining if a sequence polymorphism is the present in a subject, such as a human. The method includes providing a nucleic acid from the subject and contacting the nucleic acid with an oligonucleotide that hybridizes to a polymorphic sequence selected from the group consisting of SEQ ID NOS: 1–1192, or its complement, provided that the polymorphic sequence includes a nucleotide other than the nucleotide recited in Table 1, column 5 for said polymorphic sequence, or the complement includes a nucleotide other than the complement of the nucleotide recited in Table 1, column 5. Hybridization between the nucleic acid and the oligonucleotide is then determined. Hybridization of the oligonucleotide to the nucleic acid sequence indicates the presence of the polymorphism in said subject.

In another aspect, the invention provides an isolated polypeptide comprising a polymorphic site at one or more amino acid residues, and wherein the protein is encoded by a polynucleotide including one of the polymorphic sequences SEQ ID NOS:1–1192, or their complement, provided that the polymorphic sequence includes a nucleotide other than the nucleotide recited in Table 1, column 5 for the polymorphic sequence, or the complement includes a nucleotide other than the complement of the nucleotide recited in Table 1, column 5.

The polypeptide can be, e.g., related to one of the protein families disclosed herein. For example, polypeptide can be related to angiopoietin, 4-hydroxybutyrate dehydrogenase, ATP-dependent RNA helicase, MHC Class I histocompatibility antigen, or phosphoglycerate kinase.

In some embodiments, the polypeptide is translated in the same open reading frame as is a wild type protein whose amino acid sequence is identical to the amino acid sequence of the polymorphic protein except at the site of the polymorphism.

In some embodiments, the polypeptide encoded by the polymorphic sequence, or its complement, includes the nucleotide listed in Table 1, column 6 for the polymorphic sequence, or the complement includes the complement of the nucleotide listed in Table 1, column 6.

The invention also provides an antibody that binds specifically to a polypeptide encoded by a polynucleotide comprising a nucleotide sequence encoded by a polynucleotide selected from the group consisting of polymorphic sequences SEQ ID NOS:1–1192, or its complement. The polymorphic sequence includes a nucleotide other than the nucleotide recited in Table 1, column 5 for the polymorphic sequence, or the complement includes a nucleotide other than the complement of the nucleotide recited in Table 1, column 5.

In some embodiments, the antibody binds specifically to a polypeptide encoded by a polymorphic sequence which includes the nucleotide listed in Table 1, column 6 for the polymorphic sequence.

Preferably, the antibody does not bind specifically to a polypeptide encoded by a polymorphic sequence which includes the nucleotide listed in Table 1, column 5 for the polymorphic sequence.

The invention further provides a method of detecting the presence of a polypeptide having one or more amino acid residue polymorphisms in a subject. The method includes providing a protein sample from the subject and contacting the sample with the above-described antibody under conditions that allow for the formation of antibody-antigen complexes. The antibody-antigen complexes are then detected. The presence of the complexes indicates the presence of the polypeptide.

The invention also provides a method of treating a subject suffering from, at risk for, or suspected of, suffering from a pathology ascribed to the presence of a sequence polymorphism in a subject, e.g., a human, non-human primate, cat, dog, rat, mouse, cow, pig, goat, or rabbit. The method includes providing a subject suffering from a pathology associated with aberrant expression of a first nucleic acid comprising a polymorphic sequence selected from the group consisting of SEQ ID NOS:1–1192, or its complement, and treating the subject by administering to the subject an effective dose of a therapeutic agent. Aberrant expression can include qualitative alterations in expression of a gene, e.g., expression of a gene encoding a polypeptide having an altered amino acid sequence with respect to its wild-type counterpart. Qualitatively different polypeptides can include, shorter, longer, or altered polypeptides relative to the amino acid sequence of the wild-type polypeptide. Aberrant expression can also include quantitative alterations in expression of a gene. Examples of quantitative alterations in gene expression include lower or higher levels of expression of the gene relative to its wild-type counterpart, or alterations in the temporal or tissue-specific expression pattern of a gene. Finally, aberrant expression may also include a combination of qualitative and quantitative alterations in gene expression.

The therapeutic agent can include, e.g., second nucleic acid comprising the polymorphic sequence, provided that the second nucleic acid comprises the nucleotide present in the wild type allele. In some embodiments, the second nucleic acid sequence comprises a polymorphic sequence which includes nucleotide listed in Table 1, column 5 for the polymorphic sequence.

Alternatively, the therapeutic agent can be a polypeptide encoded by a polynucleotide comprising polymorphic sequence selected from the group consisting of SEQ ID NOS:1–1192, or by a polynucleotide comprising a nucleotide sequence that is complementary to any one of polymorphic sequences SEQ ID NOS:1–1192, provided that the polymorphic sequence includes the nucleotide listed in Table 1, column 6 for the polymorphic sequence.

The therapeutic agent may further include an antibody as herein described, or an oligonucleotide comprising a polymorphic sequence selected from the group consisting of SEQ ID NOS:1–1192, or by a polynucleotide comprising a nucleotide sequence that is complementary to any one of polymorphic sequences SEQ ID NOS:1–1192, provided that the polymorphic sequence includes the nucleotide listed in Table 1, column 5 or Table 1, column 6 for the polymorphic sequence, In another aspect, the invention provides an oligonucleotide array comprising one or more oligonucleotides hybridizing to a first polynucleotide at a polymorphic site encompassed therein. The first polynucleotide can be, e.g., a nucleotide sequence comprising one or more polymorphic sequences (SEQ ID NOS:1–1192); a nucleotide sequence that is a fragment of any of the nucleotide sequence, provided that the fragment includes a polymorphic site in the polymorphic sequence; a complementary nucleotide sequence comprising a sequence complementary to one or more polymorphic sequences (SEQ ID NOS:1–1192); or a nucleotide sequence that is a fragment of the complementary sequence, provided that the fragment includes a polymorphic site in the polymorphic sequence.

In preferred embodiments, the he array comprises 10; 100; 1,000; 10,000; 100,000 or more oligonucleotides.

The invention also provides a kit comprising one or more of the herein-described nucleic acids. The kit can include, e.g., polynucleotide which includes one or more of the SNPs described herein. The polynucleotide can be, e.g., a nucleotide sequence which includes one or more of the polymorphic sequences shown in Table 1 (SEQ ID NOS: 1–1192) and which includes a polymorphic sequence, or a fragment of the polymorphic sequence, as long as it includes the polymorphic site. The polynucleotide may alternatively contain a nucleotide sequence which includes a sequence complementary to one or more of the sequences (SEQ ID NOS:1–1192), or a fragment of the complementary nucleotide sequence, provided that the fragment includes a polymorphic site in the polymorphic sequence. Alternatively, or in addition, the kit can include the invention provides an isolated allele-specific oligonucleotide that hybridizes to a first polynucleotide containing a polymorphic site. The first polynucleotide can be, e.g., a nucleotide sequence comprising one or more polymorphic sequences (SEQ ID NOS:1–1192), provided that the polymorphic sequence includes a nucleotide other than the nucleotide recited in Table 1, column 5 for the polymorphic sequence. Alternatively, the first polynucleotide can be a nucleotide sequence that is a fragment of the polymorphic sequence, provided that the fragment includes a polymorphic site in the polymorphic sequence, or a complementary nucleotide sequence which includes a sequence complementary to one or more polymorphic sequences (SEQ ID NOS:1–1192), provided that the complementary nucleotide sequence includes a nucleotide other than the complement of the nucleotide recited in Table 1, column 5. The first polynucleotide may in addition include a nucleotide sequence that is a fragment of the complementary sequence, provided that the fragment includes a polymorphic site in the polymorphic sequence.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In the case of conflict, the present specification, including definitions, will control. In addition, the materials, methods, and examples are illustrative only and not intended to be limiting.

Other features and advantages of the invention will be apparent from the following detailed description and claims.

DETAILED DESCRIPTION OF THE INVENTION

The invention provides human SNPs in sequences which are transcribed, i.e., are cSNPs, and which have not been previously described. As is explained in more detail below, many SNPs have been identified in genes related to polypeptides of known function. If desired, SNPs associated with various polypeptides can be used together. For example, SNPs can be grouped according to whether they are derived from a nucleic acid encoding a polypeptide related to particular protein family or involved in a particular function. Thus, SNPs related to ATPase associated protein may be used together, as may SNPs associated with cadherin, or ephrin (EPH), or any of the other proteins recited in Table 1, column 10. Similarly, SNPs can be grouped according to the functions played by their gene products. Such functions include, structural proteins, proteins from which associated with metabolic pathways fatty acid metabolism, glycolysis, intermediary metabolism, calcium metabolism, proteases, and amino acid metabolism, etc.

The SNPs are shown in Table 1. Table 1 provides a summary of the polymorphic sequences disclosed herein. In the Table, a "SNP" is a polymorphic site embedded in a polymorphic sequence. The polymorphic site is occupied by a single nucleotide, which is the position of nucleotide variation between the wild type and polymorphic allelic sequences. The site is usually preceded by and followed by relatively highly conserved sequences of the allele (e.g., sequences that vary in less than 1/100 or 1/1000 members of the populations). Thus, a polymorphic sequence can include one or more of the following sequences: (1) a sequence having the nucleotide denoted in Table 1, column 5 at the polymorphic site in the polymorphic sequence: and (2) a sequence having a nucleotide other than the nucleotide denoted in Table 1, column 5 at the polymorphic site in the polymorphic sequence. An example of the latter sequence is a polymorphic sequence having the nucleotide denoted in Table 1, column 6 at the polymorphic site in the polymorphic sequence.

Nucleotide sequences for a referenced-polymorphic pair are presented in Table 1. The choice of designating one sequence of the cognate pair as a "reference" sequence and the second cognate of the pair as a "polymorphic" sequence is arbitrary. Each cSNP entry provides information concerning both the reference nucleotide sequence as well as the cognate polymorphic sequence occurring at a given polymorphic site. Each row of the Table provides this information for a given reference-polymorphism cognate pair. A reference to the sequence identifier number providing the sequences of both alleles is also provided. In addition, references to the SEQ ID NOS: giving the translated amino acid sequences are also given if appropriate.

Table 1 includes thirteen columns that provide descriptive information for each cSNP, each of which occupies one row in the Table. The column headings, and an explanation for each, are given below.

"SEQ ID" provides the cross-references to the two nucleotide SEQ ID NOS: for the cognate pair, which are numbered consecutively, and, as explained below, amino acid SEQ ID NOS: as well, in the Sequence Listing of the application. Conversely, each sequence entry in the Sequence Listing also includes a cross-reference to the CuraGen sequence ID, under the label "Accession number". The first pair of SEQ ID NOS: given in the first column of each row of the Table is the SEQ ID NO: identifying the nucleic acid sequence for the polymorphism. If a polymorphism carries an entry for the amino acid portion of the row, a third SEQ ID NO: appears in parentheses in the column "Amino acid before" (see below) for the reference amino acid sequence, and a fourth SEQ ID NO: appears in parentheses in the column "Amino acid after" (see below) for the polymorphic amino acid sequence. The latter SEQ ID NOS: refer to amino acid sequences giving the cognate reference and polymorphic amino acid sequences that are the translation of the nucleotide polymorphism. If a polymorphism carries no entry for the protein portion of the row, only one pair SEQ ID NOS: is provided, in the first column.

"CuraGen sequence ID" provides CuraGen Corporation's accession number.

"Base pos. of SNP" gives the numerical position of the nucleotide in the nucleic acid at which the cSNP is found, as identified in this invention.

"Polymorphic sequence" provides a 51-base sequence with the polymorphic site at the $26^{th}$ base in the sequence, as well as 25 bases from the reference sequence on the 5' side and the 3' side of the polymorphic site. The designation at the polymorphic site is enclosed in square brackets, and provides first, the reference nucleotide; second, a "slash (/)"; and third, the polymorphic nucleotide. In certain cases the polymorphism is an insertion or a deletion. In that case, the position that is "unfilled" (i.e., the reference or the polymorphic position) is indicated by the word "gap".

"Base before" provides the nucleotide present in the reference sequence at the position at which the polymorphism is found.

"Base after" provides the altered nucleotide at the position of the polymorphism. "Amino acid before" provides the amino acid in the reference protein, if the polymorphism occurs in a coding region. This column also includes the SEQ ID NO: in parentheses for the translated reference amino acid sequence if the polymorphism occurs in a coding region.

"Amino acid after" provides the amino acid in the polymorphic protein, if the polymorphism occurs in a coding region. This column also includes the SEQ ID NO: in parentheses for the translated polymorphic amino acid sequence if the polymorphism occurs in a coding region.

"Type of change" provides information on the nature of the polymorphism. "SILENT-NONCODING" is used if the polymorphism occurs in a noncoding region of a nucleic acid. "SILENT-CODING" is used if the polymorphism occurs in a coding region of a nucleic acid of a nucleic acid and results in no change of amino acid in the translated polymorphic protein. "CONSERVATIVE" is used if the polymorphism occurs in a coding region of a nucleic acid and provides a change in which the altered amino acid falls in the same class as the reference amino acid. The classes are: 1) Aliphatic: Gly, Ala, Val, Leu, Ile; 2) Aromatic: Phe, Tyr, Trp; 3) Sulfur-containing: Cys, Met; 4) Aliphatic OH: Ser, Thr; 5) Basic: Lys, Arg, His; 6) Acidic: Asp, Glu, Asn, Gln; 7) Pro falls in none of the other classes; and 8) End defines a termination codon.

"NONCONSERVATIVE" is used if the polymorphism occurs in a coding region of a nucleic acid and provides a change in which the altered amino acid falls in a different class than the reference amino acid.

"FRAMESHIFT" relates to an insertion or a deletion. If the frameshift occurs in a coding region, the Table provides the translation of the frameshifted codons 3' to the polymorphic site.

"Protein classification of CuraGen gene" provides a generic class into which the protein is classified. Approximately multiple classes of proteins were identified. The classes include the following:

Examples of possible disease correlations between the claimed SNPs with members of the genes of each classification are listed below for representative protein families.

Amylases

Amylase is responsible for endohydrolysis of 1,4-alpha-glucosidic linkages in oligosaccharides and polysaccharides. Variations in amylase gene may be indicative of delayed maturation and of various amylase producing neoplasms and carcinomas.

Amyloid

The serum amyloid A (SAA) proteins comprise a family of vertebrate proteins that associate predominantly with high-density lipoproteins (HDL). The synthesis of certain members of the family is greatly increased in inflammation. Prolonged elevation of plasma SAA levels, as in chronic inflammation, 15 results in a pathological condition, called amyloidosis, which affects the liver, kidney and spleen and which is characterized by the highly insoluble accumulation of SAA in these tissues. Amyloid selectively inhibits insulin-stimulated glucose utilization and glycogen deposition in muscle, while not affecting adipocyte glucose metabolism. Deposition of fibrillar amyloid proteins intraneuronally, as neurofibrillary tangles, extracellularly, as plaques and in blood vessels, is characteristic of both Alzheimer's disease and aged Down's syndrome. Amyloid deposition is also associated with type II diabetes mellitus.

Angiopoeitin

Members of the angiopoeitin/fibrinogen family have been shown to stimulate the generation of new blood vessels, inhibit the generation of new blood vessels, and perform several roles in blood clotting. This generation of new blood vessels, called angiogenesis, is also an essential step in tumor growth in order for the tumor to get the blood supply that it needs to expand. Variation in these genes may be predictive of any form of heart disease, numerous blood clotting disorders, stroke, hypertension and predisposition to tumor formation and metastasis. In particular, these variants may be predictive of the response to various antihypertensive drugs and chemotherapeutic and anti-tumor agents.

Apoptosis-Related Proteins

Active cell suicide (apoptosis) is induced by events such as growth factor withdrawal and toxins. It is controlled by regulators, which have either an inhibitory effect on programmed cell death (anti-apoptotic) or block the protective effect of inhibitors (pro-apoptotic). Many viruses have found a way of countering defensive apoptosis by encoding their own anti-apoptosis genes preventing their target-cells from dying too soon. Variants of apoptosis related genes may be useful in formulation of anti-aging drugs.

Cadherin, Cyclin, Polymerase, Oncogenes, Histones, Kinases

Members of the cell division/cell cycle pathways such as cyclins, many transcription factors and kinases, DNA polymerases, histones, helicases and other oncogenes play a critical role in carcinogenesis where the uncontrolled proliferation of cells leads to tumor formation and eventually metastasis. Variation in these genes may be predictive of predisposition to any form of cancer, from increased risk of tumor formation to increased rate of metastasis. In particular, these variants may be predictive of the response to various chemotherapeutic and anti-tumor agents.

Colony-Stimulating Factor-Related Proteins

Granulocyte/macrophage colony-stimulating factors are cytokines that act in hematopoiesis by controlling the production, differentiation, and function of 2 related white cell populations of the blood, the granulocytes and the monocytes-macrophages.

Complement-Related Proteins

Complement proteins are immune associated cytotoxic agents, acting in a chain reaction to exterminate target cells to that were opsonized (primed) with antibodies, by forming a membrane attack complex (MAC). The mechanism of killing is by opening pores in the target cell membrane. Variations in 20 complement genes or their inhibitors are associated with many autoimmune disorders. Modified serum levels of complement products cause edemas of various tissues, lupus (SLE), vasculitis, glomerulonephritis, renal failure, hemolytic anemia, thrombocytopenia, and arthritis. They interfere with mechanisms of ADCC (antibody dependent cell cytotoxicity), severely impair immune competence and reduce phagocytic ability. Variants of complement genes may also be indicative of type I diabetes mellitus, meningitis neurological disorders such as Nemaline myopathy, Neonatal hypotonia, muscular disorders such as congenital myopathy and other diseases.

Cytochrome

The respiratory chain is a key biochemical pathway which is essential to all aerobic cells. There are five different cytochromes involved in the chain. These are heme bound proteins which serve as electron carriers. Modifications in these genes may be predictive of ataxia areflexia, dementia and myopathic and neuropathic changes in muscles. Also, association with various types of solid tumors.

Kinesins

Kinesins are tubulin molecular motors that function to transport organelles within cells and to move chromosomes along microtubules during cell division. Modifications of these genes may be indicative of neurological disorders such as Pick disease of the brain, tuberous sclerosis.

Cytokines, Interferon, Interleukin

Members of the cytokine families are known for their potent ability to stimulate cell growth and division even at low concentrations. Cytokines such as erythropoietin are cell-specific in their growth stimulation; erythropoietin is useful for the stimulation of the proliferation of erythroblasts. Variants in cytokines may be predictive for a wide variety of diseases, including cancer predisposition.

G-protein Coupled Receptors

G-protein coupled receptors (also called R7G) are an extensive group of hormones, neurotransmitters, odorants and light receptors which transduce extracellular signals by interaction with guanine nucleotide-binding (G) proteins. Alterations in genes coding for G-coupled proteins may be involved in and indicative of a vast number of physiological conditions. These include blood pressure regulation, renal dysfunctions, male infertility, dopamine associated cognitive, emotional, and endocrine functions, hypercalcemia, chondrodysplasia and osteoporosis, pseudohypoparathyroidism, growth retardation and dwarfism.

Thioesterases

Eukaryotic thiol proteases are a family of proteolytic enzymes which contain an active site cysteine. Catalysis proceeds through a thioester intermediate and is facilitated by a nearby histidine side chain; an asparagine completes the essential catalytic triad. Variants of thioester associated genes may be predictive of neuronal disorders and mental illnesses such as Ceroid Lipoffiscinosis, Neuronal 1, Infantile, Santavuori disease and more.

"Name of protein identified following a BLASTX analysis of the CuraGen sequence" provides the database reference for the protein found to resemble the novel reference-polymorphism cognate pair most closely.

"Similarity (pvalue) following a BLASTX analysis" provides the pvalue, a statistical measure from the BLASTX analysis that the polymorphic sequence is similar to, and therefore an allele of, the reference, or wild-type, sequence. In the present application, a cutoff of pvalue $>1\times10^{-50}$ (entered, for example, as 1.0E–50 in the Table) is used to establish that the reference-polymorphic cognate pairs are novel. A pvalue $<1\times10^{-50}$ defines proteins considered to be already known.

"Map location" provides any information available at the time of filing related to localization of a gene on a chromosome.

The polymorphisms are arranged in Table 1 in the following order:

SEQ ID NOS: 1 to 1112, in consecutive pairs, are SNPs that are silent;

SEQ ID NOS: 1113–1128, in consecutive pairs, are SNPs that lead to conservative amino acid changes;

SEQ ID NOS: 1129–1186, in consecutive pairs, are SNPs that lead to nonconservative amino acid changes; and SEQ ID NOS: 1187–1192, in consecutive pairs, are SNPs that involve a gap.

With respect to the reference or wild-type sequence at the position of the polymorphism, the allelic cSNP introduces an additional nucleotide (an insertion) or deletes a nucleotide (a deletion). A SNP that involves a gap generates a frame shift.

Also presented in the sequence listing filed herewith are predicted amino acid sequences encoded by the polymorphic sequences shown in Table 1. SEQ ID NOS: 1193–1208, in consecutive pairs, are the amino acid sequences centered at the polymorphic amino acid residue for the protein products provided by SNPs that lead to conservative amino acid changes between the reference and the polymorphic sequences. 7 or 8 amino acids on either side of the polymorphic site are shown. The order in which these sequences appear mirrors the order of presentation of the cognate nucleotide sequences, and is set forth in Table 1.

SEQ ID NOS: 1209–1266, in consecutive pairs, are the amino acid sequences centered at the polymorphic amino acid residue for the protein products provided by SNPs that lead to nonconservative amino acid changes between the reference and the polymorphic sequences. 7 or 8 amino acids on either side of the polymorphic site are shown. The order in which these sequences appear mirrors the order of presentation of the cognate nucleotide sequences, and is set forth in the Table.

SEQ ID NOS: 1267–1272, in consecutive pairs, are the amino acid sequences centered at the polymorphic amino acid residue for the protein products provided by SNPs that lead to frameshift-induced amino acid changes between the reference and the polymorphic sequences. 7 or 8 amino acids on either side of the polymorphic site are shown. The order in which these sequences appear mirrors the order of presentation of the cognate nucleotide sequences, and is set forth in Table 1.

Provided herein are compositions which include, or are capable of detecting, nucleic acid sequences having these polymorphisms, as well as methods of using nucleic acids.

Identification of Individuals Carrying SNPs

Individuals carrying polymorphic alleles of the invention may be detected at either the DNA, the RNA, or the protein level using a variety of techniques that are well known in the art. Strategies for identification and detection are described in e.g., EP 730,663, EP 717,113, and PCT US97/02102. The present methods usually employ pre-characterized polymorphisms. That is, the genotyping location and nature of polymorphic forms present at a site have already been determined. The availability of this information allows sets of probes to be designed for specific identification of the known polymorphic forms.

Many of the methods described below require amplification of DNA from target samples. This can be accomplished by e.g., PCR. (1989), B. for detecting polymorphisms. See generally PCR Technology: Principles and Applications for DNA Amplification (ed. H. A. Erlich, Freeman Press, NY, N.Y., 1992); PCR Protocols: A Guide to Methods and Applications (eds. Innis, et al., Academic Press, San Diego, Calif., 1990); Mattila et al., Nucleic Acids Res. 19, 4967 (1991); Eckert et al., PCR Methods and Applications 1, 17 (1991); PCR (eds. McPherson et al., IRL Press, Oxford); and U.S. Pat. No. 4,683,202.

The phrase "recombinant protein" or "recombinantly produced protein" refers to a peptide or protein produced using non-native cells that do not have an endogenous copy of DNA able to express the protein. In particular, as used herein, a recombinantly produced protein relates to the gene product of a polymorphic allele, i.e., a "polymorphic protein" containing an altered amino acid at the site of translation of the nucleotide polymorphism. The cells produce the protein because they have been genetically altered by the introduction of the appropriate nucleic acid sequence. The recombinant protein will not be found in association with proteins and other subcellular components normally associated with the cells producing the protein. The terms "protein" and "polypeptide" are used interchangeably herein.

The phrase "substantially purified" or "isolated" when referring to a nucleic acid, peptide or protein, means that the chemical composition is in a milieu containing fewer, or preferably, essentially none, of other cellular components with which it is naturally associated. Thus, the phrase "isolated" or "substantially pure" refers to nucleic acid preparations that lack at least one protein or nucleic acid normally associated with the nucleic acid in a host cell. It is preferably in a homogeneous state although it can be in either a dry or aqueous solution. Purity and homogeneity are typically determined using analytical chemistry techniques such as gel electrophoresis or high performance liquid chromatography. Generally, a substantially purified or isolated nucleic acid or protein will comprise more than 80% of all macromolecular species present in the preparation. Preferably, the nucleic acid or protein is purified to represent greater than 90% of all macromolecular species present. More preferably the nucleic acid or protein is purified to greater than 95%, and most preferably the nucleic acid or protein is purified to essential homogeneity, wherein other macromolecular species are not detected by conventional analytical procedures.

The genomic DNA used for the diagnosis may be obtained from any nucleated cells of the body, such as those present in peripheral blood, urine, saliva, buccal samples, surgical specimen, and autopsy specimens. The DNA may be used directly or may be amplified enzymatically in vitro through use of PCR (Saiki et al. *Science* 239:487–491 (1988)) or other in vitro amplification methods such as the ligase chain reaction (LCR) (Wu and Wallace *Genomics* 4:560–569 (1989)), strand displacement amplification (SDA) (Walker et al. *Proc. Natl. Acad. Sci. U.S.A,* 89:392–396 (1992)), self-sustained sequence replication (3SR) (Fahy et al. PCR Methods P&J& 1:25–33 (1992)), prior to mutation analysis.

The method for preparing nucleic acids in a form that is suitable for mutation detection is well known in the art. A "nucleic acid" is a deoxyribonucleotide or ribonucleotide polymer in either single-or double-stranded form, including known analogs of natural nucleotides unless otherwise indicated. The term "nucleic acids", as used herein, refers to either DNA or RNA. "Nucleic acid sequence" or "polynucleotide sequence" refers to a single-stranded sequence of deoxyribonucleotide or ribonucleotide bases read from the 5' end to the 3' end. The direction of 5' to 3' addition of nascent RNA transcripts is referred to as the transcription direction; sequence regions on the DNA strand having the same sequence as the RNA and which are beyond the 5' end of the RNA transcript in the 5' direction are referred to as "upstream sequences"; sequence regions on the DNA strand having the same sequence as the RNA and which are beyond the 3' end of the RNA transcript in the 3' direction are referred to as "downstream sequences". The term includes both self-replicating plasmids, infectious polymers of DNA or RNA and nonfunctional DNA or RNA. The complement of any nucleic acid sequence of the invention is understood to be included in the definition of that sequence. "Nucleic acid probes" may be DNA or RNA fragments.

The detection of polymorphisms in specific DNA sequences, can be accomplished by a variety of methods including, but not limited to, restriction-fragment-length-polymorphism detection based on allele-specific restriction-endonuclease cleavage (Kan and Dozy Lancet ii:910–912 (1978)), hybridization with allele-specific oligonucleotide probes (Wallace et al. Nucl. Acids Res. 6:3543–3557 (1978)), including immobilized oligonucleotides (Saiki et al. Proc. Natl. Acad. SCI. USA, 86:6230–6234 (1969)) or oligonucleotide arrays (Maskos and Southern Nucl. Acids Res 21:2269–2270 (1993)), allele-specific PCR (Newton et al. Nucl Acids Res 17:2503–2516 (1989)), mismatch-repair detection (MRD) (Faham and Cox Genome Res 5:474–482 (1995)), binding of MutS protein (Wagner et al. Nucl Acids Res 23:3944–3948 (1995), denaturing-gradient gel electrophoresis (DGGE) (Fisher and Lerman et al. Proc. Natl. Acad. Sci. U.S.A. 80:1579–1583 (1983)), single-strand-confirmation-polymorphism detection (Orita et al. Genomics 5:874–879 (1983)), RNAase cleavage at mismatched base-pairs (Myers et al. Science 230:1242 (1985)), chemical (Cotton et al. Proc. Natl. w Sci. U.S.A, 8Z4397–4401 (1988)) or enzymatic (Youil et al. Proc. Natl. Acad. Sci. U.S.A. 92:87–91 (1995)) cleavage of heteroduplex DNA, methods based on allele specific primer extension (Syvanen et al. Genomics 8:684–692 (1990)), genetic bit analysis (GBA) (Nikiforov et al. &&I Acids 22:4167–4175 (1994)), the oligonucleotide-ligation assay (OLA) (Landegren et al. Science 241:1077 (1988)), the allele-specific ligation chain reaction (LCR) (Barrany Proc. Natl. Acad. Sci. U.S.A. 88:189–193 (1991)), gap-LCR (Abravaya et al. Nucl Acids Res 23:675–682 (1995)), radioactive and/or fluorescent DNA sequencing using standard procedures well known in the art, and peptide nucleic acid (PNA) assays (Orum et al., Nucl. Acids Res, 21:5332–5356 (1993); Thiede et al., Nucl. Acids Res. 24:983–984 (1996)).

"Specific hybridization" or "selective hybridization" refers to the binding, or duplexing, of a nucleic acid molecule only to a second particular nucleotide sequence to which the nucleic acid is complementary, under suitably stringent conditions when that sequence is present in a complex mixture (e.g., total cellular DNA or RNA). "Stringent conditions" are conditions under which a probe will hybridize to its target subsequence, but to no other sequences. Stringent conditions are sequence-dependent and are different in different circumstances. Longer sequences hybridize specifically at higher temperatures than shorter ones. Generally, stringent conditions are selected such that the temperature is about 5° C. lower than the thermal melting point (Tm) for the specific sequence to which hybridization is intended to occur at a defined ionic strength and pH. The Tm is the temperature (under defined ionic strength, pH, and nucleic acid concentration) at which 50% of the target sequence hybridizes to the complementary probe at equilibrium. Typically, stringent conditions include a salt concentration of at least about 0.01 to about 1.0 M Na ion concentration (or other salts), at pH 7.0 to 8.3. The temperature is at least about 30° C. for short probes (e.g., 10 to 50 nucleotides). Stringent conditions can also be achieved with the addition of destabilizing agents such as formamide. For example, conditions of 5× SSPE (750 mM NaCl, 50 mM NaPhosphate, 5 mM EDTA, pH 7.4) and a temperature of 25–30° C. are suitable for allele-specific probe hybridizations.

"Complementary" or "target" nucleic acid sequences refer to those nucleic acid sequences which selectively hybridize to a nucleic acid probe. Proper annealing conditions depend, for example, upon a probe's length, base composition, and the number of mismatches and their position on the probe, and must often be determined empirically. For discussions of nucleic acid probe design and annealing conditions, see, for example, Sambrook et al., or Current Protocols in Molecular Biology, F. Ausubel et al., ed., Greene Publishing and Wiley-Interscience, New York (1987).

A perfectly matched probe has a sequence perfectly complementary to a particular target sequence. The test probe is typically perfectly complementary to a portion of the target sequence. A "polymorphic" marker or site is the locus at which a sequence difference occurs with respect to a reference sequence. Polymorphic markers include restriction fragment length polymorphisms, variable number of tandem repeats (VNTR's), hypervariable regions, minisatellites, dinucleotide repeats, trinucleotide repeats, tetranucleotide repeats, simple sequence repeats, and insertion elements such as Alu. The reference allelic form may be, for example, the most abundant form in a population, or the first allelic form to be identified, and other allelic forms are designated as alternative, variant or polymorphic alleles. The allelic form occurring most frequently in a selected population is sometimes referred to as the "wild type" form, and herein may also be referred to as the "reference" form. Diploid organisms may be homozygous or heterozygous for allelic forms. A diallelic polymorphism has two distinguishable forms (i.e., base sequences), and a triallelic polymorphism has three such forms.

As use herein an "oligonucleotide" is a single-stranded nucleic acid ranging in length from 2 to about 60 bases. Oligonucleotides are often synthetic but can also be produced from naturally occurring polynucleotides. A probe is an oligonucleotide capable of binding to a target nucleic acid of complementary sequence through one or more types of chemical bonds, usually through complementary base pairing via hydrogen bond formation. Oligonucleotides probes are often between 5 and 60 bases, and, in specific embodiments, may be between 10–40, or 15–30 bases long. An oligonucleotide probe may include natural (i.e. A, G, C, or T) or modified bases (7-deazaguanosine, inosine, etc.). In addition, the bases in an oligonucleotide probe may be joined by a linkage other than a phosphodiester bond, such as a phosphoramidite linkage or a phosphorothioate linkage, or they may be peptide nucleic acids in which the constituent bases are joined by peptide bonds rather than by phosphodiester bonds, so long as it does not interfere with hybridization.

As used herein, the term "primer" refers to a single-stranded oligonucleotide which acts as a point of initiation of template-directed DNA synthesis under appropriate conditions (e.g., in the presence of four different nucleoside triphosphates and a polymerization agent, such as DNA polymerase, RNA polymerase or reverse transcriptase) in an appropriate buffer and at a suitable temperature. The appropriate length of a primer depends on the intended use of the primer, but typically ranges from 15 to 30 nucleotides. Short primer molecules generally require cooler temperatures to form sufficiently stable hybrid complexes with the template. A primer need not be perfectly complementary to the exact sequence of the template, but should be sufficiently complementary to hybridize with it. The term "primer site" refers to the sequence of the target DNA to which a primer hybridizes. The term "primer pair" refers to a set of primers including a 5' (upstream) primer that hybridizes with the 5' end of the DNA sequence to be amplified and a 3' (downstream) primer that hybridizes with the complement of the 3' end of the sequence to be amplified.

DNA fragments can be prepared, for example, by digesting plasmid DNA, or by use of PCR. Oligonucleotides for use as primers or probes are chemically synthesized by methods known in the field of the chemical synthesis of polynucleotides, including by way of non-limiting example the phosphoramidite method described by Beaucage and Carruthers, *Tetrahedron Lett* 22:1859–1862 (1981) and the triester method provided by Matteucci, et al., *J. Am. Chem. Soc.*, 103:3185 (1981) both incorporated herein by reference. These syntheses may employ an automated synthesizer, as described in Needham-VanDevanter, D. R., et al., *Nucleic Acids Res.* 12:61596168 (1984). Purification of oligonucleotides may be carried out by either native acrylamide gel electrophoresis or by anion-exchange HPLC as described in Pearson, J. D. and Regnier, F. E., ,J. Chrom, 255:137–149 (1983). A double stranded fragment may then be obtained, if desired, by annealing appropriate complementary single strands together under suitable conditions or by synthesizing the complementary strand using a DNA polymerase with an appropriate primer sequence. Where a specific sequence for a nucleic acid probe is given, it is understood that the complementary strand is also identified and included. The complementary strand will work equally well in situations where the target is a double-stranded nucleic acid.

The sequence of the synthetic oligonucleotide or of any nucleic acid fragment can be can be obtained using either the dideoxy chain termination method or the Maxam-Gilbert method (see Sambrook et al. *Molecular Cloning—a Laboratory Manual* (2nd Ed.), Vols. 1–3, Cold Spring Harbor Laboratory, Cold Spring Harbor, N.Y., (1989), which is incorporated herein by reference. This manual is hereinafter referred to as "Sambrook et al."; Zyskind at al., (1988)). Recombinant DNA Laboratory Manual, (Acad. Press, New York). Oligonucleotides useful in diagnostic assays are typically at least 8 consecutive nucleotides in length, and may range upwards of 18 nucleotides in length to greater than 100 or more consecutive nucleotides.

Another aspect of the invention pertains to isolated antisense nucleic acid molecules that are hybridizable to or complementary to the nucleic acid molecule comprising the SNP-containing nucleotide sequences of the invention, or fragments, analogs or derivatives thereof. An "antisense" nucleic acid comprises a nucleotide sequence that is complementary to a "sense" nucleic acid encoding a protein, e.g., complementary to the coding strand of a double-stranded cDNA molecule or complementary to an mRNA sequence. In specific aspects, antisense nucleic acid molecules are provided that comprise a sequence complementary to at least about 10, about 25, about 50, or about 60 nucleotides or an entire SNP coding strand, or to only a portion thereof.

In one embodiment, an antisense nucleic acid molecule is antisense to a "coding region" of the coding strand of a polymorphic nucleotide sequence of the invention. The term "coding region" refers to the region of the nucleotide sequence comprising codons which are translated into amino acid. In another embodiment, the antisense nucleic acid molecule is antisense to a "noncoding region" of the coding strand of a nucleotide sequence of the invention. The term "noncoding region" refers to 5' and 3' sequences which flank the coding region that are not translated into amino acids (i.e., also referred to as 5' and 3' untranslated regions).

Given the coding strand sequences disclosed herein, antisense nucleic acids of the invention can be designed according to the rules of Watson and Crick or Hoogsteen base pairing. For example, the antisense nucleic acid molecule can generally be complementary to the entire coding region of an mRNA, but more preferably as embodied herein, it is an oligonucleotide that is antisense to only a portion of the coding or noncoding region of the mRNA. An antisense oligonucleotide can range in length between about 5 and about 60 nucleotides, preferably between about 10 and about 45 nucleotides, more preferably between about 15 and 40 nucleotides, and still more preferably between about 15 and 30 in length. An antisense nucleic acid of the invention can be constructed using chemical synthesis or enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used.

Examples of modified nucleotides that can be used to generate the antisense nucleic acid include: 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3) w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject or generated in situ such that they hybridize with or bind to cellular mRNA and/or genomic DNA encoding a polymorphic protein to thereby inhibit expression of the protein, e.g., by inhibiting transcription and/or translation. The hybridization can be by conventional nucleotide complementary to form a stable duplex, or, for example, in the case of an antisense nucleic acid molecule that binds to DNA duplexes, through specific interactions in the major groove of the double helix. An example of a route of administration of anti sense nucleic acid molecules of the invention includes direct injection at a tissue site. Alternatively, antisense nucleic acid molecules can be modified to target selected cells and then administered systemically. For example, for systemic administration, antisense molecules can be modified such that they specifically bind to receptors or antigens expressed on a selected cell surface, e.g., by linking the antisense nucleic acid molecules to peptides or antibodies that bind to cell surface receptors or antigens. The antisense nucleic acid molecules can also be delivered to cells using the vectors described herein. To achieve sufficient intracellular concentrations of antisense molecules, vector constructs in which the antisense nucleic acid molecule is placed under the control of a strong pol II or pol III promoter are preferred.

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual units, the strands run parallel to each other (Gaultier et al. (1987) *Nucleic Acids Res* 15: 6625–6641). The antisense nucleic acid molecule can also comprise a 2'-o-methylribonucleotide (Inoue et al. (1987) *Nucleic Acids Res* 15: 6131–6148) or a chimeric RNA-DNA analogue (Inoue et al. (1987) *FEBS Lett* 215: 327–330).

The following terms are used to describe the sequence relationships between two or more nucleic acids or polynucleotides: "reference sequence", "comparison window", "sequence identity", "percentage of sequence identity", and "substantial identity". A "reference sequence" is a defined sequence used as a basis for a sequence comparison; a reference sequence may be a subset of a larger sequence, for example, as a segment of a full-length cDNA or gene sequence given in a sequence listing, or may comprise a complete cDNA or gene sequence. Optimal alignment of sequences for aligning a comparison window may, for example, be conducted by the local homology algorithm of Smith and Waterman *Adv. Appl. Math.* 2482 (1981), by the homology alignment algorithm of Needleman and Wunsch *J. Mol. Biol.* 48:443 (1970), by the search for similarity method of Pearson and Lipman *Proc. Natl. Acad. Sci. U.S.A.* 852444 (1988), or by computerized implementations of these algorithms (for example, GAP, BESTFIT, FASTA, and TFASTA in the Wisconsin Genetics Software Package Release 7.0, Genetics Computer Group, 575 Science Dr., Madison, Wis.).

Techniques for nucleic acid manipulation of the nucleic acid sequences harboring the cSNP's of the invention, such as subcloning nucleic acid sequences encoding polypeptides into expression vectors, labeling probes, DNA hybridization, and the like, are described generally in Sambrook et al., The phrase "nucleic acid sequence encoding" refers to a nucleic acid which directs the expression of a specific protein, peptide or amino acid sequence. The nucleic acid sequences include both the DNA strand sequence that is transcribed into RNA and the RNA sequence that is translated into protein, peptide or amino acid sequence. The nucleic acid sequences include both the full length nucleic acid sequences disclosed herein as well as non-full length sequences derived from the full length protein. It being further understood that the sequence includes the degenerate codons of the native sequence or sequences which may be introduced to provide codon preference in a specific host cell. Consequently, the principles of probe selection and array design can readily be extended to analyze more complex polymorphisms (see EP 730,663). For example, to characterize a triallelic SNP polymorphism, three groups of probes can be designed tiled on the three polymorphic forms as described above. As a further example, to analyze a diallelic polymorphism involving a deletion of a nucleotide, one can tile a first group of probes based on the undeleted polymorphic form as the reference sequence and a second group of probes based on the deleted form as the reference sequence.

For assay of genomic DNA, virtually any biological convenient tissue samples include whole blood, semen, saliva, tears, urine, fecal material, sweat, buccal, skin and hair can be used. Genomic DNA is typically amplified before analysis. Amplification is usually effected by PCR using primers flanking a suitable fragment e.g., of 50–500 nucleotides containing the locus of the polymorphism to be analyzed. Target is usually labeled in the course of amplification. The amplification product can be RNA or DNA, single stranded or double stranded. If double stranded, the amplification product is typically denatured before application to an array. If genomic DNA is analyzed without amplification, it may be desirable to remove RNA from the sample before applying it to the array. Such can be accomplished by digestion with DNase-free RNAase.

Detection of Polymorphisms in a Nucleic Acid Sample

The SNPs disclosed herein can be used to determine which forms of a characterized polymorphism are present in individuals under analysis.

The design and use of allele-specific probes for analyzing polymorphisms is described by e.g., Saiki et al., Nature 324, 163–166 (1986); Dattagupta, EP 235,726, Saiki, WO 89/11548. Allele-specific probes can be designed that hybridize to a segment of target DNA from one individual but do not hybridize to the corresponding segment from another individual due to the presence of different polymorphic forms in the respective segments from the two individuals. Hybridization conditions should be sufficiently stringent that there is a significant difference in hybridization intensity between alleles, and preferably an essentially binary response, whereby a probe hybridizes to only one of the alleles. Some probes are designed to hybridize to a segment of target DNA such that the polymorphic site aligns with a central position (e.g., in a 15-mer at the 7 position; in a 16-mer, at either the 7, 8 or 9 position) of the probe. This design of probe achieves good discrimination in hybridization between different allelic forms.

Allele-specific probes are often used in pairs, one member of a pair showing a perfect match to a reference form of a target sequence and the other member showing a perfect match to a variant form. Several pairs of probes can then be immobilized on the same support for simultaneous analysis of multiple polymorphisms within the same target sequence.

The polymorphisms can also be identified by hybridization to nucleic acid arrays, some examples of which are described in oublished PCT application WO 95/11995. WO 95/11995 also describes subarrays that are optimized for detection of a variant form of a precharacterized polymorphism. Such a subarray contains probes designed to be complementary to a second reference sequence, which is an allelic variant of the first reference sequence. The second group of probes is designed by the same principles, except that the probes exhibit complementarity to the second reference sequence. The inclusion of a second group (or further groups) can be particularly useful for analyzing short subsequences of the primary reference sequence in which multiple mutations are expected to occur within a short distance commensurate with the length of the probes (e.g., two or more mutations within 9 to 21 bases).

An allele-specific primer hybridizes to a site on target DNA overlapping a polymorphism and only primes amplification of an allelic form to which the primer exhibits perfect complementarity. See Gibbs, Nucleic Acid Res. 17 2427–2448 (1989). This primer is used in conjunction with a second primer which hybridizes at a distal site. Amplification proceeds from the two-primers, resulting in a detectable product which indicates the particular allelic form is present. A control is usually performed with a second pair of primers, one of which shows a single base mismatch at the polymorphic site and the other of which exhibits perfect complementarity to a distal site. The single-base mismatch prevents amplification and no detectable product is formed. The method works best when the mismatch is included in the 3'-most position of the oligonucleotide aligned with the polymorphism because this position is most destabilizing to elongation from the primer (see, e.g., WO 93/22456).

Amplification products generated using the polymerase chain reaction can be analyzed by the use of denaturing gradient gel electrophoresis. Different alleles can be identified based on the different sequence-dependent melting properties and electrophoretic migration of DNA in solution. Erlich, ed., PCR Technology, Principles and Applications for DNA Amplification, (W. H. Freeman and Co New York, 1992, Chapter 7).

Alleles of target sequences can be differentiated using single-strand conformation polymorphism analysis, which identifies base differences by alteration in electrophoretic migration of single stranded PCR products, as described in Orita et al., Proc. Nat. Acad. Sci. 86, 2766–2770 (1989). Amplified PCR products can be generated and heated or otherwise denatured, to form single stranded amplification products. Single-stranded nucleic acids may refold or form secondary structures which are partially dependent on the base sequence. The different electrophoretic mobilities of single-stranded amplification products can be related to base-sequence differences between alleles of target sequences.

The genotype of an individual with respect to a pathology suspected of being caused by a genetic polymorphism may be assessed by association analysis. Phenotypic traits suitable for association analysis include diseases that have known but hitherto unmapped genetic components (e.g., agammaglobulinemia, diabetes insipidus, Lesch-Nyhan syndrome, muscular dystrophy, Wiskott-Aldrich syndrome, Fabry's disease, familial hypercholesterolemia, polycystic kidney disease, hereditary spherocytosis, von Willebrand's disease, tuberous sclerosis, hereditary hemorrhagic telangiectasia, familial colonic polyposis, Ehlers-Danlos syndrome, osteogenesis imperfecta, and acute intermittent porphyria).

Phenotypic traits also include symptoms of, or susceptibility to, multifactorial diseases of which a component is or may be genetic, such as autoimmune diseases, inflammation, cancer, system, diseases of the nervous and infection by pathogenic microorganisms. Some examples of autoimmune diseases include rheumatoid arthritis, multiple sclerosis, diabetes (insulin-dependent and non-independent), systemic lupus erythematosus and Graves disease. Some examples of cancers include cancers of the bladder, brain, breast, colon, esophagus, kidney, oral cavity, ovary, pancreas, prostate, skin, stomach, leukemia, liver, lung, and uterus. Phenotypic traits also include characteristics such as longevity, appearance (e.g., baldness, obesity), strength, speed, endurance, fertility, and susceptibility or receptivity to particular drugs or therapeutic treatments.

Such correlations can be exploited in several ways. In the case of a strong correlation between a polymorphic form and a disease for which treatment is available, detection of the polymorphic form set in a human or animal patient may justify immediate administration of treatment, or at least the institution of regular monitoring of the patient. Detection of a polymorphic form correlated with serious disease in a couple contemplating a family may also be valuable to the couple in their reproductive decisions. For example, the female partner might elect to undergo in vitro fertilization to avoid the possibility of transmitting such a polymorphism from her husband to her offspring. In the case of a weaker, but still statistically significant correlation between a polymorphic set and human disease, immediate therapeutic intervention or monitoring may not be justified. Nevertheless, the patient can be motivated to begin simple life-style changes (e.g., diet, exercise) that can be accomplished at little cost to the patient but confer potential benefits in reducing the risk of conditions to which the patient may have increased susceptibility by virtue of variant alleles. After determining polymorphic form(s) present in an individual at one or more polymorphic sites, this information can be used in a number of methods.

Determination of which polymorphic forms occupy a set of polymorphic sites in an individual identifies a set of polymorphic forms that distinguishes the individual. See generally National Research Council, *The Evaluation of Forensic DNA Evidence* (Eds. Pollard et al., National Academy Press, DC, 1996). Since the polymorphic sites are within a 50,000 bp region in the human genome, the probability of recombination between these polymorphic sites is low. That low probability means the haplotype (the set of all 10 polymorphic sites) set forth in this application should be inherited without change for at least several generations. The more sites that are analyzed the lower the probability that the set of polymorphic forms in one individual is the same as that in an unrelated individual. Preferably, if multiple sites are analyzed, the sites are unlinked. Thus, polymorphisms of the invention are often used in conjunction with polymorphisms in distal genes. Preferred polymorphisms for use in forensics are diallelic because the population frequencies of two polymorphic forms can usually be determined with greater accuracy than those of multiple polymorphic forms at multi-allelic loci.

The capacity to identify a distinguishing or unique set of forensic markers in an individual is useful for forensic analysis. For example, one can determine whether a blood sample from a suspect matches a blood or other tissue sample from a crime scene by determining whether the set of polymorphic forms occupying selected polymorphic sites is the same in the suspect and the sample. If the set of polymorphic markers does not match between a suspect and a sample, it can be concluded (barring experimental error) that the suspect was not the source of the sample. If the set of markers does match, one can conclude that the DNA from the suspect is consistent with that found at the crime scene. If frequencies of the polymorphic forms at the loci tested have been determined (e.g., by analysis of a suitable population of individuals), one can perform a statistical analysis to determine the probability that a match of suspect and crime scene sample would occur by chance.

p(ID) is the probability that two random individuals have the same polymorphic or allelic form at a given polymorphic site. In diallelic loci, four genotypes are possible: AA, AB, BA, and BB. If alleles A and B occur in a haploid genome of the organism with frequencies x and y, the probability of each genotype in a diploid organism are (see WO 95/12607):

Homozygote: $p(AA)=x^2$

Homozygote: $p(BB)=y^2=(1-x)^2$

Single Heterozygote: $p(AB)=p(BA)=xy=x(1-x)$

Both Heterozygotes: $p(AB+BA)=2xy=2x(1-x)$

The probability of identity at one locus (i.e, the probability that two individuals, picked at random from a population will have identical polymorphic forms at a given locus) is given by the equation:

$p(ID)=(x^2)^2+(2xy)^2+(y^2)^2.$

These calculations can be extended for any number of polymorphic forms at a given locus. For example, the probability of identity p(ID) for a 3-allele system where the alleles have the frequencies in the population of x, y and z, respectively, is equal to the sum of the squares of the genotype frequencies:

$p(ID)=x^4+(2xy)^2+(2yz)^2+(2xz)^2+z^4+y^4$

In a locus of n alleles, the appropriate binomial expansion is used to calculate p(ID) and p(exc).

The cumulative probability of identity (cum p(ID)) for each of multiple unlinked loci is determined by multiplying the probabilities provided by each locus:

cum $p(ID)=p(ID1)p(ID2)p(ID3) \ldots p(IDn)$

The cumulative probability of non-identity for n loci (i.e. the probability that two random individuals will be different at 1 or more loci) is given by the equation:

cum $p(nonID)=1-$cum $p(ID).$

If several polymorphic loci are tested, the cumulative probability of non-identity for random individuals becomes very high (e.g., one billion to one). Such probabilities can be taken into account together with other evidence in determining the guilt or innocence of the suspect.

The object of paternity testing is usually to determine whether a male is the father of a child. In most cases, the mother of the child is known and thus, the mother's contribution to the child's genotype can be traced. Paternity testing investigates whether the part of the child's genotype not attributable to the mother is consistent with that of the putative father. Paternity testing can be performed by analyzing sets of polymorphisms in the putative father and the child.

If the set of polymorphisms in the child attributable to the father does not match the putative father, it can be concluded, barring experimental error, that the putative father is not the real father. If the set of polymorphisms in the child attributable to the father does match the set of polymorphisms of the putative father, a statistical calculation can be performed to determine the probability of coincidental match.

The probability of parentage exclusion (representing the probability that a random male will have a polymorphic form at a given polymorphic site that makes him incompatible as the father) is given by the equation (see WO 95/12607):

$p(exc)=xy(1-xy)$ where x and y are the population frequencies of alleles A and B of a diallelic polymorphic site. (At a triallelic site p(exc)= $xy(1-xy)+yz(1-yz)+xz(1-xz)+3xyz(1-xyz)))$, where x, y and z and the respective population frequencies of alleles A, B and C). The probability of non-exclusion is:

$p(non-exc)=1-p(exc)$

The cumulative probability of non-exclusion (representing the value obtained when n loci are used) is thus:

cum $p(non-exc)=p(non-exc1)p(non-exc2)p(non-exc3) \ldots p(non-excn)$

The cumulative probability of exclusion for n loci (representing the probability that a random male will be excluded) is:

cum $p(exc)=1-$cum $p(non-exc).$

If several polymorphic loci are included in the analysis, the cumulative probability of exclusion of a random male is very high. This probability can be taken into account in assessing the liability of a putative father whose polymorphic marker set matches the child's polymorphic marker set attributable to his/her father.

The polymorphisms of the invention may contribute to the phenotype of an organism in different ways. Some polymorphisms occur within a protein coding sequence and contribute to phenotype by affecting protein structure. The effect may be neutral, beneficial or detrimental, or both beneficial and detrimental, depending on the circumstances. For example, a heterozygous sickle cell mutation confers resistance to malaria, but a homozygous sickle cell mutation is usually lethal. Other polymorphisms occur in noncoding regions but may exert phenotypic effects indirectly via influence on replication, transcription, and translation. A single polymorphism may affect more than one phenotypic trait. Likewise, a single phenotypic trait may be affected by polymorphisms in different genes. Further, some polymorphisms predispose an individual to a distinct mutation that is causally related to a certain phenotype.

Phenotypic traits include diseases that have known but hitherto unmapped genetic components. Phenotypic traits also include symptoms of, or susceptibility to, multifactorial diseases of which a component is or may be genetic, such as autoimmune diseases, inflammation, cancer, diseases of the nervous system, and infection by pathogenic microorganisms. Some examples of autoimmune diseases include rheumatoid arthritis, multiple sclerosis, diabetes (insulin-dependent and non-independent), systemic lupus erythematosus and Graves disease. Some examples of cancers include cancers of the bladder, brain, breast, colon, esophagus, kidney, leukemia, liver, lung, oral cavity, ovary, pancreas, prostate, skin, stomach and uterus. Phenotypic traits also include characteristics such as longevity, appearance (e.g., baldness, obesity), strength, speed, endurance, fertility, and susceptibility or receptivity to particular drugs or therapeutic treatments.

Correlation is performed for a population of individuals who have been tested for the presence or absence of a phenotypic trait of interest and for polymorphic markers sets. To perform such analysis, the presence or absence of a set of polymorphisms (i.e. a polymorphic set) is determined for a set of the individuals, some of whom exhibit a particular trait, and some of which exhibit lack of the trait. The alleles of each polymorphism of the set are then reviewed to determine whether the presence or absence of a particular allele is associated with the trait of interest. Correlation can be performed by standard statistical methods such as a κ-squared test and statistically significant correlations between polymorphic form(s) and phenotypic characteristics are noted. For example, it might be found that the presence of allele A1 at polymorphism A correlates with heart disease. As a further example, it might be found that the combined presence of allele A1 at polymorphism A and allele B1 at polymorphism B correlates with increased milk production of a farm animal.

Such correlations can be exploited in several ways. In the case of a strong correlation between a set of one or more polymorphic forms and a disease for which treatment is available, detection of the polymorphic form set in a human or animal patient may justify immediate administration of treatment, or at least the institution of regular monitoring of the patient. Detection of a polymorphic form correlated with serious disease in a couple contemplating a family may also be valuable to the couple in their reproductive decisions. For example, the female partner might elect to undergo in vitro fertilization to avoid the possibility of transmitting such a polymorphism from her husband to her offspring. In the case of a weaker, but still statistically significant correlation between a polymorphic set and human disease, immediate therapeutic intervention or monitoring may not be justified. Nevertheless, the patient can be motivated to begin simple life-style changes (e.g., diet, exercise) that can be accomplished at little cost to the patient but confer potential benefits in reducing the risk of conditions to which the patient may have increased susceptibility by virtue of variant alleles. Identification of a polymorphic set in a patient correlated with enhanced receptiveness to one of several treatment regimes for a disease indicates that this treatment regime should be followed.

For animals and plants, correlations between characteristics and phenotype are useful for breeding for desired characteristics. For example, Beitz et al., U.S. Pat. No. 5,292,639 discuss use of bovine mitochondrial polymorphisms in a breeding program to improve milk production in cows. To evaluate the effect of mtDNA D-loop sequence polymorphism on milk production, each cow was assigned a value of 1 if variant or 0 if wild type with respect to a prototypical mitochondrial DNA sequence at each of 17 locations considered.

The previous section concerns identifying correlations between phenotypic traits and polymorphisms that directly or indirectly contribute to those traits. The present section describes identification of a physical linkage between a genetic locus associated with a trait of interest and polymorphic markers that are not associated with the trait, but are in physical proximity with the genetic locus responsible for the trait and co-segregate with it. Such analysis is useful for mapping a genetic locus associated with a phenotypic trait to a chromosomal position, and thereby cloning gene(s) responsible for the trait. See Lander et al., *Proc. Natl. Acad. Sci.* (*USA*) 83, 7353–7357 (1986); Lander et al., *Proc. Natl. Acad. Sci.* (*USA*) 84, 2363–2367 (1987); Donis-Keller et al., *Cell* 51, 319–337 (1987); Lander et al., *Genetics* 121, 185–199 (1989)). Genes localized by linkage can be cloned by a process known as directional cloning. See Wainwright, *Med. J. Australia* 159, 170–174 (1993); Collins, *Nature Genetics* 1, 3–6 (1992) (each of which is incorporated by reference in its entirety for all purposes).

Linkage studies are typically performed on members of a family. Available members of the family are characterized for the presence or absence of a phenotypic trait and for a set of polymorphic markers. The distribution of polymorphic markers in an informative meiosis is then analyzed to determine which polymorphic markers co-segregate with a phenotypic trait. See, e.g., Kerem et al., *Science* 245, 1073–1080 (1989); Monaco et al., *Nature* 316, 842 (1985); Yamoka et al., *Neurology* 40, 222–226 (1990); Rossiter et al., *FASEB Journal* 5, 21–27 (1991).

Linkage is analyzed by calculation of LOD (log of the odds) values. A lod value is the relative likelihood of obtaining observed segregation data for a marker and a genetic locus when the two are located at a recombination fraction $\theta$, versus the situation in which the two are not linked, and thus segregating independently (Thompson & Thompson, *Genetics in Medicine* (5th ed, W. B. Saunders Company, Philadelphia, 1991); Strachan, "Mapping the human genome" in *The Human Genome* (BIOS Scientific Publishers Ltd, Oxford), Chapter 4). A series of likelihood ratios are calculated at various recombination fractions ($\theta$), ranging from $\theta=0.0$ (coincident loci) to $\theta=0.50$ (unlinked). Thus, the likelihood at a given value of $\theta$ is: probability of data if loci linked at $\theta$ to probability of data if loci unlinked. The computed likelihood is usually expressed as the $\log_{10}$ of this ratio (i.e., a lod score). For example, a lod score of 3 indicates 1000:1 odds against an apparent observed linkage being a coincidence. The use of logarithms allows data collected from different families to be combined by simple addition. Computer programs are available for the calculation of lod scores for differing values of $\theta$ (e.g., LIPED, MLINK (Lathrop, *Proc. Nat. Acad Sci.* (USA) 81, 3443–3446 (1984)). For any particular lod score, a recombination fraction may be determined from mathematical tables. See Smith et al., *Mathematical tables for research workers in human genetics* (Churchill, London, 1961); Smith, *Ann. Hum. Genet.* 32, 127–150 (1968). The value of $\theta$ at which the lod score is the highest is considered to be the best estimate of the recombination fraction.

Positive lod score values suggest that the two loci are linked, whereas negative values suggest that linkage is less likely (at that value of $\theta$) than the possibility that the two loci are unlinked. By convention, a combined lod score of +3 or greater (equivalent to greater than 1000:1 odds in favor of linkage) is considered definitive evidence that two loci are linked. Similarly, by convention, a negative lod score of −2 or less is taken as definitive evidence against linkage of the two loci being compared. Negative linkage data are useful in excluding a chromosome or a segment thereof from consideration. The search focuses on the remaining non-excluded chromosomal locations.

The invention further provides transgenic nonhuman animals capable of expressing an exogenous variant gene and/or having one or both alleles of an endogenous variant gene inactivated. Expression of an exogenous variant gene is usually achieved by operably linking the gene to a promoter and optionally an enhancer, and microinjecting the construct into a zygote. See Hogan et al., "Manipulating the Mouse Embryo, A Laboratory Manual," Cold Spring Harbor Laboratory. (1989). Inactivation of endogenous variant genes can be achieved by forming a transgene in which a cloned variant gene is inactivated by insertion of a positive selection marker. See Capecchi, Science 244, 1288–1292 The transgene is then introduced into an embryonic stem cell, where it undergoes homologous recombination with an endogenous variant gene. Mice and other rodents are preferred animals. Such animals provide useful drug screening systems.

The invention further provides methods for assessing the pharmacogenomic susceptibility of a subject harboring a single nucleotide polymorphism to a particular pharmaceutical compound, or to a class of such compounds. Genetic polymorphism in drug-metabolizing enzymes, drug transporters, receptors for pharmaceutical agents, and other drug targets have been correlated with individual differences based on distinction in the efficacy and toxicity of the pharmaceutical agent administered to a subject. Pharmocogenomic characterization of a subjects susceptibility to a drug enhances the ability to tailor a dosing regimen to the particular genetic constitution of the subject, thereby enhancing and optimizing the therapeutic effectiveness of the therapy.

In cases in which a cSNP leads to a polymorphic protein that is ascribed to be the cause of a pathological condition, method of treating such a condition includes administering to a subject experiencing the pathology the wild type cognate of the polymorphic protein. Once administered in an effective dosing regimen, the wild type cognate provides complementation or remediation of the defect due to the polymorphic protein. The subject's condition is ameliorated by this protein therapy.

A subject suspected of suffering from a pathology ascribable to a polymorphic protein that arises from a cSNP is to be diagnosed using any of a variety of diagnostic methods capable of identifying the presence of the cSNP in the nucleic acid, or of the cognate polymorphic protein, in a suitable clinical sample taken from the subject. Once the presence of the cSNP has been ascertained, and the pathology is correctable by administering a normal or wild-type gene, the subject is treated with a pharmaceutical composition that includes a nucleic acid that harbors the correcting wild-type gene, or a fragment containing a correcting sequence of the wild-type gene. Non-limiting examples of ways in which such a nucleic acid may be administered include incorporating the wild-type gene in a viral vector, such as an adenovirus or adeno associated virus, and administration of a naked DNA in a pharmaceutical composition that promotes intracellular uptake of the administered nucleic acid. Once the nucleic acid that includes the gene coding for the wild-type allele of the polymorphism is incorporated within a cell of the subject, it will initiate de novo biosynthesis of the wild-type gene product. If the nucleic acid is further incorporated into the genome of the subject, the treatment will have long-term effects, providing de novo synthesis of the wild-type protein for a prolonged duration. The synthesis of the wild-type protein in the cells of the subject will contribute to a therapeutic enhancement of the clinical condition of the subject.

A subject suffering from a pathology ascribed to a SNP may be treated so as to correct the genetic defect. (See Kren et al., Proc. Natl. Acad. Sci. USA 96:10349–10354 (1999)). Such a subject is identified by any method that can detect the polymorphism in a sample drawn from the subject. Such a genetic defect may be permanently corrected by administering to such a subject a nucleic acid fragment incorporating a repair sequence that supplies the wild-type nucleotide at the position of the SNP. This site-specific repair sequence encompasses an RNA/DNA oligonucleotide which operates to promote endogenous repair of a subject's genomic DNA. Upon administration in an appropriate vehicle, such as a complex with polyethylenimine or encapsulated in anionic liposomes, a genetic defect leading to an inborn pathology may be overcome, as the chimeric oligonucleotides induces incorporation of the wild-type sequence into the subject's genome. Upon incorporation, the wild-type gene product is expressed, and the replacement is propagated, thereby engendering a permanent repair.

The invention further provides kits comprising at least one allele-specific oligonucleotide as described above. Often, the kits contain one or more pairs of allele-specific oligonucleotides hybridizing to different forms of a polymorphism. In some kits, the allele-specific oligonucleotides are provided immobilized to a substrate. For example, the same substrate can comprise allele-specific oligonucleotide probes for detecting at least 10, 100, 1000 or all of the polymorphisms shown in the Table. Optional additional components of the kit include, for example, restriction enzymes, reverse-transcriptase or polymerase, the substrate nucleoside triphosphates, means used to label (for example, an avidin-enzyme conjugate and enzyme substrate and chromogen if the label is biotin), and the appropriate buffers for reverse transcription, PCR, or hybridization reactions. Usually, the kit also contains instructions for carrying out the hybridizing methods.

Several aspects of the present invention rely on having available the polymorphic proteins encoded by the nucleic acids comprising a SNP of the inventions. There are various methods of isolating these nucleic acid sequences. For example, DNA is isolated from a genomic or cDNA library using labeled oligonucleotide probes having sequences complementary to the sequences disclosed herein.

Such probes can be used directly in hybridization assays. Alternatively probes can be designed for use in amplification techniques such as PCR.

To prepare a cDNA library, mRNA is isolated from tissue such as heart or pancreas, preferably a tissue wherein expression of the gene or gene family is likely to occur. cDNA is prepared from the mRNA and ligated into a recombinant vector. The vector is transfected into a recombinant host for propagation, screening and cloning. Methods for making and screening cDNA libraries are well known, See Gubler, U. and Hoffman, B. J. Gene 25:263–269 (1983) and Sambrook et al.

For a genomic library, for example, the DNA is extracted from tissue and either mechanically sheared or enzymatically digested to yield fragments of about 12–20 kb. The fragments are then separated by gradient centrifugation from undesired sizes and are constructed in bacteriophage lambda vectors. These vectors and phage are packaged in vitro, as described in Sambrook, et al. Recombinant phage are analyzed by plaque hybridization as described in Benton and Davis, Science 196:180–182 (1977). Colony hybridization is carried out as generally described in M. Grunstein et al. Proc. Natl. Acad. Sci. USA. 72:3961–3965 (1975). DNA of interest is identified in either cDNA or genomic libraries by its ability to hybridize with nucleic acid probes, for example on Southern blots, and these DNA regions are isolated by standard methods familiar to those of skill in the art. See Sambrook, et al.

In PCR techniques, oligonucleotide primers complementary to the two 3' borders of the DNA region to be amplified are synthesized. The polymerase chain reaction is then carried out using the two primers. See PCR Protocols: a Guide to Methods and Applications (Innis, M, Gelfand, D., Sninsky, J. and White, T., eds.), Academic Press, San Diego (1990). Primers can be selected to amplify the entire regions encoding a full-length sequence of interest or to amplify smaller DNA. segments as desired. PCR can be used in a variety of protocols to isolate cDNA's encoding a sequence of interest. In these protocols, appropriate primers and probes for amplifying DNA encoding a sequence of interest are generated from analysis of the DNA sequences listed herein. Once such regions are PCR-amplified, they can be sequenced and oligonucleotide probes can be prepared from the sequence.

Once DNA encoding a sequence comprising a cSNP is isolated and cloned, one can express the encoded polymorphic proteins in a variety of recombinantly engineered cells. It is expected that those of skill in the art are knowledgeable in the numerous expression systems available for expression of DNA encoding a sequence of interest. No attempt to describe in detail the various methods known for the expression of proteins in prokaryotes or eukaryotes is made here.

In brief summary, the expression of natural or synthetic nucleic acids encoding a sequence of interest will typically be achieved by operably linking the DNA or cDNA to a promoter (which is either constitutive or inducible), followed by incorporation into an expression vector. The vectors can be suitable for replication and integration in either prokaryotes or eukaryotes. Typical expression vectors contain, initiation sequences, transcription and translation terminators, and promoters useful for regulation of the expression of a polynucleotide sequence of interest. To obtain high level expression of a cloned gene, it is desirable to construct expression plasmids which contain, at the minimum, a strong promoter to direct transcription, a ribosome binding site for translational initiation, and a transcription/translation terminator. The expression vectors may also comprise generic expression cassettes containing at least one independent terminator sequence, sequences permitting replication of the plasmid in both eukaryotes and prokaryotes, i.e., shuttle vectors, and selection markers for both prokaryotic and eukaryotic systems. See Sambrook et al.

A variety of prokaryotic expression systems may be used to express the polymorphic proteins of the invention. Examples include *E. coli*, Bacillus, Streptomyces, and the like.

It is preferred to construct expression plasmids which contain, at the minimum, a strong promoter to direct transcription, a ribosome binding site for translational initiation, and a transcription/translation terminator. Examples of regulatory regions suitable for this purpose in *E. coli* are the promoter and operator region of the *E. coli* tryptophan biosynthetic pathway as described by Yanofsky, C., J. Bacterial. 158:1018–1024 (1984) and the leftward promoter of phage lambda (P) as described by A, I. and Hagen, D., *Ann. Rev. Genet*. 14:399–445 (1980). The inclusion of selection markers in DNA vectors transformed in *E. coli* is also useful. Examples of such markers include genes specifying resistance to ampicillin, tetracycline, or chloramphenicol. See Sambrook et al. for details concerning selection markers for use in *E. coli*.

To enhance proper folding of the expressed recombinant protein, during purification from *E. coli*, the expressed protein may first be denatured and then renatured. This can be accomplished by solubilizing the bacterially produced proteins in a chaotropic agent such as guanidine HCl and reducing all the cysteine residues with a reducing agent such as beta-mercaptoethanol. The protein is then renatured, either by slow dialysis or by gel filtration. See U.S. Pat. No. 4,511,503. Detection of the expressed antigen is achieved by methods known in the art as radioimmunoassay, or Western blotting techniques or immunoprecipitation. Purification from *E. coli* can be achieved following procedures such as those described in U.S. Pat. No. 4,511,503.

Any of a variety of eukaryotic expression systems such as yeast, insect cell lines, bird, fish, and mammalian cells, may also be used to express a polymorphic protein of the invention. As explained briefly below, a nucleotide sequence harboring a cSNP may be expressed in these eukaryotic systems. Synthesis of heterologous proteins in yeast is well known. *Methods in Yeast Genetics*, Sherman, F., et al., Cold Spring Harbor Laboratory, (1982) is a well recognized work describing the various methods available to produce the protein in yeast. Suitable vectors usually have expression control sequences, such as promoters, including 3-phosphogtycerate kinase or other glycolytic enzymes, and an origin of replication, termination sequences and the like as desired. For instance, suitable vectors are described in the literature (Botstein, et al., Gene 8:17–24 (1979); Broach, et al., Gene 8:121–133 (1979)).

Two procedures are used in transforming yeast cells. In one case, yeast cells are first converted into protoplasts using zymolyase, lyticase or glusulase, followed by addition of DNA and polyethylene glycol (PEG). The PEG-treated protoplasts are then regenerated in a 3% agar medium under selective conditions. Details of this procedure are given in the papers by J. D. Beggs, Nature (London) 275:104–109 (1978); and Hinnen, A., et al., Proc. Natl. Acad. Sci. USA, 75:1929–1933 (1978). The second procedure does not involve removal of the cell wall. Instead the cells are treated with lithium chloride or acetate and PEG and put on selective plates (Ito, H., et al., J. Bact, 153163–168 (1983)). cells and applying standard protein isolation techniques to the lysates:.

The purification process can be monitored by using Western blot techniques or radioimmunoassay or other standard techniques. The sequences encoding the proteins of the invention can also be ligated to various immunoassay expression vectors for use in transforming cell cultures of, for instance, mammalian, insect, bird or fish origin. Illustrative of cell cultures useful for the production of the polypeptides are mammalian cells. Mammalian cell systems often will be in the form of monolayers of cells although mammalian cell suspensions may also be used. A number of suitable host cell lines capable of expressing intact proteins have been developed in the art, and include the HEK293, BHK21, and CHO cell lines, and various human cells such as COS cell lines, HeLa cells, myeloma cell lines, Jurkat cells, etc. Expression vectors for these cells can include expression control sequences, such as an origin of replication, a promoter (e.g., the CMV promoter, a HSV tk promoter or pgk (phosphoglycerate kinase) promoter), an enhancer (Queen et al. *Immunol. Rev*, 89:49 (1986)) and necessary processing information sites, such as ribosome binding sites, RNA splice sites, polyadenylation sites (e.g., an SV40 large T Ag poly A addition site), and transcriptional terminator sequences.

Other animal cells are available, for instance, from the American Type Culture Collection Catalogue of Cell Lines and Hybridomas (7th edition, (1992)). Appropriate vectors for expressing the proteins of the invention in insect cells are usually derived from baculovirus. Insect cell lines include mosquito larvae, silkworm, armyworm, moth and Drosophila cell lines such as a Schneider cell line (See Schneider J. Embryol. Exp. Morphol., 27:353–365 (1987). As indicated above, the vector, e.g., a plasmid, which is used to transform the host cell, preferably contains DNA sequences to initiate transcription and sequences to control the translation of the protein. These sequences are referred to as expression control sequences. As with yeast, when higher animal host cells are employed, polyadenylation or transcription terminator sequences from known mammalian genes need to be incorporated into the vector. An example of a terminator sequence is the polyadenylation sequence from the bovine growth hormone gene. Sequences for accurate splicing of the transcript may also be included. An example of a splicing sequence is the VP1 intron from SV40 (Sprague, J. et a/., J. Virol. 45: 773–781 (1983)). Additionally, gene sequences to control replication in the host cell may be Saveria-Campo, M., 1985, "Bovine Papilloma virus DNA a Eukaryotic Cloning Vector" in DNA Cloning Vol. II a Practical Approach Ed. D. M. Glover, IRL Press, Arlington, Va. pp. 213–238. The host cells are competent or rendered competent for transformation by various means. There are several well-known methods of introducing DNA into animal cells. These include: calcium phosphate precipitation, fusion of the recipient cells with bacterial protoplasts containing the DNA, treatment of the recipient cells with liposomes containing the DNA, DEAE dextran, electroporation and micro-injection of the DNA directly into the cells.

The transformed cells are cultured by means well known in the art (Biochemical Methods in Cell Culture and Virology, Kuchler, R. J., Dowden, Hutchinson and Ross, Inc., (1977)). The expressed polypeptides are isolated from cells grown as suspensions or as monolayers. The latter are recovered by well known mechanical, chemical or enzymatic means.

General methods of expressing recombinant proteins are also known and are exemplified in R. Kaufman, Methods in Enzymology 185, 537–566 (1990). As defined herein "operably linked" refers to linkage of a promoter upstream from a DNA sequence such that the promoter mediates transcription of the DNA sequence. Specifically, "operably linked" means that the isolated polynucleotide of the invention and an expression control sequence are situated within a vector or cell in such a way that the gene encoding the protein is expressed by a host cell which has been transformed (transfected) with the ligated polynucleotide/expression sequence. The term "vector", refers to viral expression systems, autonomous self-replicating circular DNA (plasmids), and includes both expression and nonexpression plasmids.

The term "gene" as used herein is intended to refer to a nucleic acid sequence which encodes a polypeptide. This definition includes various sequence polymorphisms, mutations, and/or sequence variants wherein such alterations do not affect the function of the gene product. The term "gene" is intended to include not only coding sequences but also regulatory regions such as promoters, enhancers, termination regions and similar untranslated nucleotide sequences. The term further includes all introns and other DNA sequences spliced from the mRNA transcript, along with variants resulting from alternative splice sites.

A number of types of cells may act as suitable host cells for expression of the protein. Mammalian host cells include, for example, monkey COS cells, Chinese Hamster Ovary (CHO) cells, human kidney 293 cells, human epidermal A43 1 cells, human Co10205 cells, 3T3 cells, CV-1 cells, other transformed primate cell lines, normal diploid cells, cell strains derived from in vitro culture of primary tissue, primary explants, HeLa cells, mouse L cells, BHK, HL-60, U937, HaK or Jurkat cells. Alternatively, it may be possible to produce the protein in lower eukaryotes such as yeast or in prokaryotes such as bacteria. Potentially suitable yeast strains include *Saccharomyces cerevisiae, Schizosaccharomyces pombe*, Kluyveromyces strains, Candida or any yeast strain capable of expressing heterologous proteins. Potentially suitable bacterial strains include *Escherichia coli, Bacillus subtilis, Salmonella typhimurium*, or any bacterial strain capable of expressing heterologous proteins. If the protein is made in yeast or bacteria, it may be necessary to modify the protein produced therein, for example by phosphorylation or glycosylation of the appropriate sites, in order to obtain the functional protein.

The protein may also be produced by operably linking the isolated polynucleotide of the invention to suitable control sequences in one or more insect expression vectors, and employing an insect expression system. Materials and methods for baculovirus/insect cell expression systems are commercially available in kit form from, e.g., Invitrogen, San Diego, Calif., U.S.A. (the MaxBac© kit), and such methods are well known in the art, as described in Summers and Smith, Texas Agricultural Experiment Station Bulletin No. 1555 (1987), incorporated herein by reference. As used herein, an insect cell capable of expressing a polynucleotide of the present invention is "transformed." The protein of the invention may be prepared by culturing transformed host cells under culture conditions suitable to express the recombinant protein.

The polymorphic protein of the invention may also be expressed as a product of transgenic animals, e.g., as a component of the milk of transgenic cows, goats, pigs, or sheep which are characterized by somatic or germ cells containing a nucleotide sequence encoding the protein. The protein may also be produced by known conventional chemical synthesis. Methods for constructing the proteins of the present invention by synthetic means are known to those skilled in the art.

The polymorphic proteins produced by recombinant DNA technology may be purified by techniques commonly employed to isolate or purify recombinant proteins. Recombinantly produced proteins can be directly expressed or expressed as a fusion protein. The protein is then purified by a combination of cell lysis (e.g., sonication) and affinity chromatography. For fusion products, subsequent digestion of the fusion protein with an appropriate proteolytic enzyme releases the desired polypeptide. The polypeptides of this invention may be purified to substantial purity by standard techniques well known in the art, including selective precipitation with such substances as ammonium sulfate, column chromatography, immunopurification methods, and others. See, for instance, R. Scopes, Protein Purification: Principles and Practice, Springer-Verlag: New York (1982), incorporated herein by reference. For example, in an embodiment, antibodies may be raised to the proteins of the invention as described herein. Cell membranes are isolated from a cell line expressing the recombinant protein, the protein is extracted from the membranes and immunoprecipitated. The proteins may then be further purified by standard protein chemistry techniques as described above.

The resulting expressed protein may then be purified from such culture (i.e., from culture medium or cell extracts) using known purification processes, such as gel filtration and ion exchange chromatography. The purification of the protein may also include an affinity column containing agents which will bind to the protein; one or more column steps over such affinity resins as concanavalin A-agarose, heparin-Toyopearl@ or Cibacrom blue 3GA Sepharose B; one or more steps involving hydrophobic interaction chromatography using such resins as phenyl ether, butyl ether, or propyl ether; or immunoaffinity chromatography. Alternatively, the protein of the invention may also be expressed in a form which will facilitate purification. For example, it may be expressed as a fusion protein, such as those of maltose binding protein (MBP), glutathione-S-transferase (GST) or thioredoxin (TRX). Kits for expression and purification of such fusion proteins are commercially available from New England BioLab (Beverly, Mass.), Pharmacia (Piscataway, N.J.) and In Vitrogen, respectively. The protein can also be tagged with an epitope and subsequently purified by using a specific antibody directed to such epitope. One such epitope ("Flag") is commercially available from Kodak (New Haven, Conn.). Finally, one or more reverse-phase high performance liquid chromatography (RP-HPLC) steps employing hydrophobic RP-HPLC media, e.g., silica gel having pendant methyl or other aliphatic groups, can be employed to further purify the protein. Some or all of the foregoing purification steps, in various combinations, can also be employed to provide a substantially homogeneous isolated recombinant protein. The protein thus purified is substantially free of other mammalian proteins and is defined in accordance with the present invention as an "isolated protein."

The term "antibody" as used herein refers to immunoglobulin molecules and immunologically active portions of immunoglobulin molecules, i.e., molecules that contain an antigen binding site that specifically binds (immunoreacts with) an antigen, such as polymorphic. Such antibodies include, but are not limited to, polyclonal, monoclonal, chimeric, single chain, $F_{ab}$ and $F_{(ab')2}$ fragments, and an $F_{ab}$ expression library. In a specific embodiment, antibodies to human polymorphic proteins are disclosed.

The phrase "specifically binds to", "immunospecifically binds to" or is "specifically immunoreactive with", an antibody when referring to a protein or peptide, refers to a binding reaction which is determinative of the presence of the protein in the presence of a heterogeneous population of proteins and other biological materials. Thus, for example, under designated immunoassay conditions, the specified antibodies bind to a particular protein and do not bind in a significant amount to other proteins present in the sample. Specific binding to an antibody under such conditions may require an antibody that is selected for its specificity for a particular protein. Of particular interest in the present invention is an antibody that binds immunospecifically to a polymorphic protein but not to its cognate wild type allelic protein, or vice versa. A variety of immunoassay formats may be used to select antibodies specifically immunoreactive with a particular protein. For example, solid-phase ELISA immunoassays are routinely used to select monoclonal antibodies specifically immunoreactive with a protein. See Harlow and Lane (1988) Antibodies, a Laboratory Manual, Cold Spring Harbor Publications, New York, for a description of immunoassay formats and conditions that can be used to determine specific immunoreactivity.

Polyclonal and/or monoclonal antibodies that immunospecifically bind to polymorphic gene products but not to the corresponding prototypical or "wild-type" gene products are also provided. Antibodies can be made by injecting mice or other animals with the variant gene product or synthetic peptide. Monoclonal antibodies are screened as are described, for example, in Harlow & Lane, Antibodies, A Laboratory Manual, Cold Spring Harbor Press, New York (1988); Goding, Monoclonal antibodies, Principles and Practice (2d ed.) Academic Press, New York (1986). Monoclonal antibodies are tested for specific immunoreactivity with a variant gene product and lack of immunoreactivity to the corresponding prototypical gene product.

An isolated polymorphic protein, or a portion or fragment thereof, can be used as an immunogen to generate the antibody that bind the polymorphic protein using standard techniques for polyclonal and monoclonal antibody preparation. The full-length polymorphic protein can be used or, alternatively, the invention provides antigenic peptide fragments of polymorphic for use as immunogens. The antigenic peptide of a polymorphic protein of the invention comprises at least 8 amino acid residues of the amino acid sequence encompassing the polymorphic amino acid and encompasses an epitope of the polymorphic protein such that an antibody raised against the peptide forms a specific immune complex with the polymorphic protein. Preferably, the antigenic peptide comprises at least 10 amino acid residues, more preferably at least 15 amino acid residues, even more preferably at least 20 amino acid residues, and most preferably at least 30 amino acid residues. Preferred epitopes encompassed by the antigenic peptide are regions of polymorphic that are located on the surface of the protein, e.g., hydrophilic regions.

For the production of polyclonal antibodies, various suitable host animals (e.g., rabbit, goat, mouse or other mammal) may be immunized by injection with the polymorphic protein. An appropriate immunogenic preparation can contain, for example, recombinantly expressed polymorphic protein or a chemically synthesized polymorphic polypeptide. The preparation can further include an adjuvant. Various adjuvants used to increase the immunological response include, but are not limited to, Freund's (complete and incomplete), mineral gels (e.g., aluminum hydroxide), surface active substances (e.g, lysolecithin, pluronic polyols, polyanions, peptides, oil emulsions, dinitrophenol, etc.), human adjuvants such as Bacille Calmette-Guerin and *Corynebacterium parvum*, or similar immunostimulatory agents. If desired, the antibody molecules directed against polymorphic proteins can be isolated from the mammal (e.g., from the blood) and further purified by well known techniques, such as protein A chromatography, to obtain the IgG fraction.

The term "monoclonal antibody" or "monoclonal antibody composition", as used herein, refers to a population of antibody molecules that originates from the clone of a singly hybridoma cell, and that contains only one type of antigen binding site capable of immunoreacting with a particular epitope of a polymorphic protein. A monoclonal antibody composition thus typically displays a single binding affinity for a particular polymorphic protein with which it immunoreacts. For preparation of monoclonal antibodies directed towards a particular polymorphic protein, or derivatives, fragments, analogs or homologs thereof, any technique that provides for the production of antibody molecules by continuous cell line culture may be utilized. Such techniques include, but are not limited to, the hybridoma technique (see Kohler & Milstein, 1975 *Nature* 256: 495–497); the trioma technique; the human B-cell hybridoma technique (see Kozbor, et al., 1983 *Immunol Today* 4: 72) and the EBV hybridoma technique to produce human monoclonal antibodies (see Cole, et al., 1985 In: Monoclonal Antibodies and Cancer Therapy, Alan R. Liss, Inc., pp. 77–96). Human monoclonal antibodies may be utilized in the practice of the present invention and may be produced by using human hybridomas (see Cote, et al., 1983. *Proc Natl Acad Sci USA* 80: 2026–2030) or by transforming human B-cells with Epstein Barr Virus in vitro (see Cole, et al., 1985 In: Monoclonal Antibodies and Cancer Therapy, Alan R. Liss, Inc., pp. 77–96).

According to the invention, techniques can be adapted for the production of single-chain antibodies specific to a polymorphic protein (see e.g., U.S. Pat. No. 4,946,778). In addition, methodologies can be adapted for the construction of $F_{ab}$ expression libraries (see e.g., Huse, et al., 1989 *Science* 246: 1275–1281) to allow rapid and effective identification of monoclonal $F_{ab}$ fragments with the desired specificity for a polymorphic protein or derivatives, fragments, analogs or homologs thereof. Non-human antibodies can be "humanized" by techniques well known in the art. See e.g., U.S. Pat. No. 5,225,539. Antibody fragments that contain the idiotypes to a polymorphic protein may be produced by techniques known in the art including, but not limited to: (i) an $F_{(ab')2}$ fragment produced by pepsin digestion of an antibody molecule; (ii) an $F_{ab}$ fragment generated by reducing the disulfide bridges of an $F_{(ab')2}$ fragment; (iii) an $F_{ab}$ fragment generated by the treatment of the antibody molecule with papain and a reducing agent and (iv) $F_v$ fragments.

Additionally, recombinant anti-polymorphic protein antibodies, such as chimeric and humanized monoclonal antibodies, comprising both human and non-human portions, which can be made using standard recombinant DNA techniques, are within the scope of the invention. Such chimeric and humanized monoclonal antibodies can be produced by recombinant DNA techniques known in the art, for example using methods described in PCT International Application No. PCT/US86/02269; European Patent Application No. 184,187; European Patent Application No. 171,496; European Patent Application No. 173,494; PCT International Publication No. WO 86/01533; U.S. Pat. No. 4,816,567; European Patent Application No. 125,023; Better et al. (1988) *Science* 240:1041–1043; Liu et al. (1987) *PNAS* 84:3439–3443; Liu et al. (1987) *J Immunol.* 139:3521–3526; Sun et al. (1987) *PNAS* 84:214–218; Nishimura et al. (1987) *Cancer Res* 47:999–1005; Wood et al. (1985) *Nature* 314:446–449; Shaw et al. (1988) *J Natl Cancer Inst* 80:1553–1559); Morrison(1985) *Science* 229:1202–1207; Oi et al. (1986) *Bio Techniques* 4:214; U.S. Pat. No. 5,225,539; Jones et al. (1986) *Nature* 321:552–525; Verhoeyan et al. (1988) *Science* 239:1534; and Beidler et al. (1988) *J Immunol* 141:4053–4060.

In one embodiment, methodologies for the screening of antibodies that possess the desired specificity include, but are not limited to, enzyme-linked immunosorbent assay (ELISA) and other immunologically-mediated techniques known within the art.

Anti-polymorphic protein antibodies may be used in methods known within the art relating to the detection, quantitation and/or cellular or tissue localization of a polymorphic protein (e.g., for use in measuring levels of the polymorphic protein within appropriate physiological samples, for use in diagnostic methods, for use in imaging the protein, and the like). In a given embodiment, antibodies for polymorphic proteins, or derivatives, fragments, analogs or homologs thereof, that contain the antibody-derived CDR, are utilized as pharmacologically-active compounds in therapeutic applications intended to treat a pathology in a subject that arises from the presence of the cSNP allele in the subject.

An anti-polymorphic protein antibody (e.g., monoclonal antibody) can be used to isolate polymorphic proteins by a variety of immunochemical techniques, such as immunoaffinity chromatography or immunoprecipitation. An anti-polymorphic protein antibody can facilitate the purification of natural polymorphic protein from cells and of recombinantly produced polymorphic proteins expressed in host cells. Moreover, an anti-polymorphic protein antibody can be used to detect polymorphic protein (e.g., in a cellular lysate or cell supernatant) in order to evaluate the abundance and pattern of expression of the polymorphic protein. Anti-polymorphic antibodies can be used diagnostically to monitor protein levels in tissue as part of a clinical testing procedure, e.g., to, for example, determine the efficacy of a given treatment regimen. Detection can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, -galactosidase, or acetylcholinesterase; examples of suitable prosthetic group complexes include streptavidin/biotin and avidin/biotin; examples of suitable fluorescent materials includes umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}I$, $^{131}I$, $^{35}S$ or $^3H$.

TABLE 1

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 1-2 | cg34158766 | 254 | TCGGGCTCGT CCAGCCAAAG | G | A | NONCOD- ING | | SILENT- ANGIOPOI- ETIN-1 - *MUS MUSCULUS* (MOUSE), 498 aa. | angiopoietin | Human Gene Similar to SPTREMBL-ID: O08538 | 6.00E-34 | 4 |
| | | | CAGCT[G/A]CC ACTCAAAAGAA AGTAGAAAGAA A | | | | | | | | | |
| 3-4 | cg43299481 | 218 | GTCCCGGTCA | G | gap | SILENT- | | dehydrogenase | Human Gene Similar to SPTREMBL-ID: Q44020 4-HYDROXY- BUTYRATE DEHYDROGE- NASE | | 9.30E-33 | |
| | | | GGGTGGGCTG | | | NONCOD- ING | | | | | | |
| | | | CGGGA[G/gap]C | | | | | (GBD), ORF 2 AND 4-10 GENES, COMPLETE | | | | |
| | | | CTCAGGCCAC | | | | | CDS, AND ORF3 AND 11, 3' END - *ALCALI- GENES EUTRO- PHUS*, 173 aa. | | | | |
| | | | GGGGAAGTAG TGGG | | | | | | | | | |
| 5-6 | cg43933536 | 1628 | ACACCGGGGG | C | T | SILENT- | | | eph | Human Gene Similar to TREMBLNEW- ID: G2735762 HEAT SHOCK PROTEIN DNAJ - *LEPTOSPIRA INTERROGANS*, 369 aa. | 7.70E-37 | 3 |
| | | | GGGCGCGGGGG | | | NONCOD- ING | | | | | | |
| | | | TCTCC[C/T]TGG | | | | | | | | | |
| | | | TCCGCAGAGA CAGCTAGCTAG C | | | | | | | | | |
| 7-8 | cg44021557 | 391 | TGATATCCAGG | T | C | Leu | Leu | SILENT- | helicase | Human Gene Similar to SWISSPROT-ID: Q11039 | 1.50E-42 | 2 |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following BLASTX analysis | Similarity (pValue) following a location | Map a |
|---|---|---|---|---|---|---|---|---|---|---|---|---|
| 9–10 | cg44021557 | | CTGAAITCTATC CCA[T/C][T]GATC TTAGGAGGAG GTGATGTACT | gap | | | | CODING | helicase | ATP-DEPENDENT RNA HELICASE DEAD HOMOLOG - *MYCOBACTERIUM TUBERCULOSIS*, 563 aa. | | 2 |
| | | 516 | GAAAGACCAAC AGGAAGGCAA AAAA[gap/A]GG AAAAACAACAA TTAAAACTGGT G | gap | A | | | SILENT-NONCODING | | Human Gene Similar to SWISSPROT-ID: Q11039 ATP-DEPENDENT RNA HELICASE DEAD HOMOLOG - *MYCOBACTERIUM TUBERCULOSIS*, 563 aa. | 1.50E-42 | |
| 11–12 | cg43305492 | 323 | TCACCATCACC AAGGACACCTC CAA[A/G]AACC AGGTGGTCCTT ACAATGACCA | A | G | Lys | Lys | SILENT-CODING | immunoglob | Human Gene Similar to TREMBLNEW-ID: G2734101 IMMUNOGLOBULIN HEAVY CHAIN, VD(5)J(4) LIKE GENE PRODUCT - *HOMO SAPIENS* (HUMAN), 151 aa. | 740E-49 | |
| 13–14 | cg43941918 | 896 | GATTAGAACCC AAATAGATCAG GAG[C/T]TGTG GAGACTGCCCT GGCTTCTGCA | C | T | Gln | Gln | SILENT-CODING | immunoglob | Human Gene Similar to TREMBLNEW-ID: G240581 IMMUNOGLOBULIN G2B VARIABLE REGION LIGHT CHAIN, AUTOANTOBODY BV04-01 VARIABLE REGION LIGHT CHAIN - MUSSP, 113 aa. | 2.80E-42 | |
| 15–16 | cg42312510 | 235 | CTACTTTGAA AGTGGGGTCC CATC[A/G]AGAT TCAGCGGCAG TGGATCTGGA | A | G | Ser | Ser | SILENT-CODING | immunoglob | Human Gene Similar to TREMBLNEW-ID: G300839 IMMUNOGLOBULIN LIGHT CHAIN VARIABLE REGION {CLONE ALPHA FOG1-A4} - *HOMO SAPIENS*, 107 aa. | 1.20E-39 | |
| 17–18 | cg43147217 | 2161 | TAACCTATTTAT TATTTATGTATT T[A/T]TTTAAGC ATCAAATATTT GTGCAAG | A | T | | | SILENT-NONCODING | interleukin | Human Gene Similar to SWISSPROT-ID: P10145 INTERLEUKIN-8 PRECURSOR (IL-8) (MONOCYTE-DERIVED NEUTROPHIL CHEMOTACTIC FACTOR) (MDNCF) (T-CELL CHEMOTACTIC FACTOR) (NEUTROPHIL-ACTIVATING PROTEIN 1) (NAP-1) (LYMPHOCYTE-DERIVED NEUTROPHIL-ACTIVATING FACTOR) (LYNAP) (PROTEIN 3-10C) (NEUTROPHIL-ACTIVATING FACTOR) (NAF) (GRANULOCYTE CHEMOTACTIC PROTEIN 1) (GCP-1) (EMOCTAKIN) - *HOMO SAPIENS* | 8.30E-48 | 4 (4q12) |
| 19–20 | cg20725546 | 402 | AGGCCGCTGA CACTCTCGTTA TTGG[T/C]GGC GGTATGGCGTA CACCTTCCTCA | T | C | Gly | Gly | SILENT-CODING | kinase | Human Gene Similar to SWISSPROT-ID: O06821 PHOSPHOGLYCERATE KINASE (EC 2.7.2.3) - *MYCOBACTERIUM TUBERCULOSIS*, 412 aa. | 9.40E-42 | |
| 21–22 | cg32160481 | 218 | GGGAAATGGC CTCTGTGGGG AGGAG[C/T]GA | C | T | | | SILENT-NONCODING | MHC | Human Gene Similar to SWISSPROT-ID: P30508 HLA CLASS HISTOCOMPATIBILITY ANTIGEN, CW*1201 ALPHA CHAIN PRE- | 5.60E-37 | |

TABLE 1-continued

| Seq ID | CuraGen sequence ID | Base pos. of SNP | Polymorphic sequence | Base before | Base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 23–24 | cg29691725 | 109 | GGGGCCCGCC CGGCGGGGGC GCA CTCGATGTCGC CCGAGACATG GAGA[T/C]CGT CGGCCCCTCG CCAAGGCATTG C | T | C | | | SILENT-NONCODING | nuclease | CURSOR (HLA-CX52) - *HOMO SAPIENS* (HUMAN), 366 aa. Human Gene Similar to TREMBLNEW-ID: E1264534 ENDONUCLEASE III - *MYCOBACTERIUM TUBERCULOSIS*, 226 aa. | 1.90E-34 | |
| 25–26 | cg29691725 | 122 | GAGACATGGA GATCGTCGGC CCCTC[G/A]CC AAGGCATTGCA AGCCGTGATC GG | G | A | | | SILENT-NONCODING | nuclease | Human Gene Similar to TREMBLNEW-ID: E1264534 ENDONUCLEASE III - *MYCOBACTERIUM TUBERCULOSIS*, 226 aa. | 1.90E-34 | |
| 27–28 | cg29691725 | 146 | CGCCAAGGCA TTGCAAGCCGT GATC[G/A]GGC ATGGGCGGC CCTCTGTGGC GT | G | A | | | SILENT-NONCODING | nuclease | Human Gene Similar to TREMBLNEW-ID: E1264534 ENDONUCLEASE III - *MYCOBACTERIUM TUBERCULOSIS*, 226 aa. | 1.90E-34 | |
| 29–30 | cg29691725 | 169 | CGGGCATGGG CCGGCCCTCT GTGGC[gap/C]g TCCCGGAACTT TTCGCAATCGG CC | gap | C | | | SILENT-NONCODING | nuclease | Human Gene Similar to TREMBLNEW-ID: E1264534 ENDONUCLEASE III - *MYCOBACTERIUM TUBERCULOSIS*, 226 aa. | 1.90E-34 | |
| 31–32 | cg29691725 | 204 | CTTTTCGCAAT CGGCCCCGAC GGCA[A/G]ATG CAGCACCCC GGTATTCCGGC CC | A | G | | | SILENT-NONCODING | nuclease | Human Gene Similar to TREMBLNEW-ID: E1264534 ENDONUCLEASE III - *MYCOBACTERIUM TUBERCULOSIS*, 226 aa. | 1.90E-34 | |
| 33–34 | cg29691725 | 231 | TGCGAGCACC CGGTATTCCG GCAT[T/C]TTCA CGCTGATGAG CTATGCCGCA A | T | C | | | SILENT-NONCODING | nuclease | Human Gene Similar to TREMBLNEW-ID: E1264534 ENDONUCLEASE III - *MYCOBACTERIUM TUBERCULOSIS*, 226 aa. | 1.90E-34 | |
| 35–36 | cg29691725 | 232 | GCGAGCACCC GGTATTCCGG CATT[T/C]TCAC GCTGATGAGCT ATGCCGCAT | T | C | | | SILENT-NONCODING | nuclease | Human Gene Similar to TREMBLNEW-ID: E1264534 ENDONUCLEASE III - *MYCOBACTERIUM TUBERCULOSIS*, 226 aa. | 1.90E-34 | |
| 37–38 | cg29691725 | 247 | TTCCGGCATTT TCACGCTGATG | T | C | | | SILENT-NONCODING | nuclease | Human Gene Similar to TREMBLNEW-ID: E1264534 ENDONUCLEASE III - | 1.90E-34 | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| | | | AGC[T/C]ATGC CCGCATCTCCC CCGCAGCCAG | | | | | | | MYCOBACTERIUM TUBERCULOSIS, 226 aa. | | |
| 39–40 | cg29691725 | 300 | AACATCAAGGC GGCCATCACC GCGC[C/T]GAA AACGTTCATCC CCCTCATCGAC | C | T | | | SILENT-NONCODING | nuclease | Human Gene Similar to TREMBLNEW-ID: E1264534 ENDONUCLEASE III - MYCOBACTERIUM TUBERCULOSIS, 226 aa. | 1.90E-34 | |
| 41–42 | cg29691725 | 80 | | ACGC-CCA-GATC | G | A | | NONCODING | SILENT- | nuclease | Human Gene Similar to TREMBLNEW-ID: E1264534 ENDONUCLEASE III - MYCOBACTERIUM TUBERCULOSIS, 226 aa. | 1.90E-34 | |
| 43–44 | cg29691725 | 89 | TCGTCACGACG GTCACGACCCT CGA[T/C]GTCG CCCGAGACAT GGAGATCGTC G | T | C | | | SILENT-NONCODING | nuclease | Human Gene Similar to TREMBLNEW-ID: E1264534 ENDONUCLEASE III - MYCOBACTERIUM TUBERCULOSIS, 226 aa. | 1.90E-34 | |
| 45–46 | cg43986329 | 1496 | GGGTTTCCCAT CAGCATTGCCG TCC[C/T]GGGT GTAGAGTCTCT CGCTGGGCA | C | T | | | SILENT-NONCODING | protease | Human Gene Similar to SWISSNEW-ID: P55032 MATRILYSIN PRECURSOR (EC 3.4.24.23) (PUMP 1 PROTEASE) (UTERINE METALLOPROTEINASE) (MATRIX METALLOPROTEINASE-7) (MMP-7) (MATRIN) - FELIS SILVESTRIS CATUS (CAT), 262 aa (fragment).| pcls: SWISSPROT-ID: P55032 MATRILYSIN PRECURSOR (EC 3.4.24.23) (PUMP 1 PROTEASE) (UTERINE METALLOPROTEINASE) (MATRIX METALLOPROTEINASE-7) (MMP-7) (MATRIN) - FELIS SILVESTRIS CATUS (CAT), 262 aa (fragment). | 2.20E-48 | 20 (16q13) |
| 47–48 | cg20438082 | 137 | CTTCAACTGCT TTAGCAACATC CAT[A/T]GTTAC AGTACCAGTTT TAGGGTTTG | A | T | Thr | Thr | SILENT-CODING | ribosomalprot | Human Gene Similar to SWISSPROT-ID: P04447 50S RIBOSOMAL PROTEIN L1 - BACILLUS STEAROTHERMOPHILUS, 232 aa. | 2.80E-40 | |
| 49–50 | cg20438082 | 206 | CAAGGACACGT CCAAGACGTCC AAC[A/T]AGAGC CATCATATCAG GTGTAGCGA | A | T | Leu | Leu | SILENT-CODING | ribosomalprot | Human Gene Similar to SWISSPROT-ID: P04447 50S RIBOSOMAL PROTEIN L1 - BACILLUS STEAROTHERMOPHILUS, 232 aa. | 2.80E-40 | |
| 51–52 | cg39547655 | 545 | GCTGGATCCAC | A | G | Gly | Gly | SILENT- | ribosomalprot | Human Gene Similar to SWISSPROT-ID: P94977 | 2.30E-38 | |

TABLE 1-continued

| Seq ID | CuraGen sequence ID | Base pos. of SNP | Polymorphic sequence | Base before | Base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 53-54 | cg29358731 | | AGCGAGCGGA AGTC[A/G]CCC TTCTTAGCACG ACGGTCACGG A | | | | | CODING | | 50S RIBOSOMAL PROTEIN L20 - *MYCOBACTERIUM TUBERCULOSIS*, 129 aa.\| pcls: SPTREMBL-ID: P94977 50S RIBOSOMAL PROTEIN L20 - MYCOBACTERIUM | | |
| 55-56 | cg29358731 | 181 | TCTCGCCTAGG TTGGTCATGAC ATG[G/T]CGAA GCTCAGCAGC GGAGATGAAG C | G | T | Arg | Arg | SILENT-CODING | struct | Human Gene Similar to SWISSPROT-ID: P93087 CALMODULIN - *CAPSICUM ANNUUM* (BELL PEPPER), 148 aa. | 2.90E-47 | |
| 57-58 | cg29358731 | 196 | TCATGACATGG CGAAGCTCAG CAGC[G/A]GAG ATGAAGCCGTT CTGGTCCTTGT | G | A | Ser | Ser | SILENT-CODING | struct | Human Gene Similar to SWISSPROT-ID: P93087 CALMODULIN - *CAPSICUM ANNUUM* (BELL PEPPER), 148 aa. | 2.90E-47 | |
| 59-60 | cg29358731 | 229 | AGCCGTTCTGG TCCTTGTCGAA CAC[A/G]CGGA AGGCCTCCTTG AGCTCCTCCT | A | G | Arg | Arg | SILENT-CODING | struct | Human Gene Similar to SWISSPROT-ID: P93087 CALMODULIN - *CAPSICUM ANNUUM* (BELL PEPPER), 148 aa. | 2.90E-47 | |
| 61-62 | cg29358731 | 301 | TGCGTGCCATC AGGTTGAGAAA CTC[A/G]GGAA AGTCGATGGTT CCATTGCCAT | A | G | Pro | Pro | SILENT-CODING | struct | Human Gene Similar to SWISSPROT-ID: P93087 CALMODULIN - *CAPSICUM ANNUUM* (BELL PEPPER), 148 aa. | 2.90E-47 | |
| 63-64 | cg29358731 | 304 | GTGCCATCAG GTTGAGAAACT CAGG[A/G]AAG TCGATGGTTCC ATTGCCATCAG | A | G | Phe | Phe | SILENT-CODING | struct | Human Gene Similar to SWISSPROT-ID: P93087 CALMODULIN - *CAPSICUM ANNUUM* (BELL PEPPER), 148 aa. | 2.90E-47 | |
| 65-66 | cg44127439 | 554 | TGCTGCGAAGA ATCTCGAGGG CCTC[C/T]TCGC GGGTAATTGAA CTCCCCCCTCA | C | T | Glu | Glu | SILENT-CODING | synthase | Human Gene Similar to SWISSPROT-ID: P19206 BIOTIN SYNTHASE (EC 2.8.1.6) (BIOTIN SYNTHETASE) - *BACILLUS SPHAERICUS*, 332 aa. | 7.90E-45 | |
| 67-68 | cg44127439 | 704 | AGTCCATGAGG CAGCACCAATG TGG[A/G]CTAC CCCGGAAAT GGTGTCGTCGT | A | G | | | SILENT-NONCODING | synthase | Human Gene Similar to SWISSPROT-ID: P19206 BIOTIN SYNTHASE (EC 2.8.1.6) (BIOTIN SYNTHETASE) - *BACILLUS SPHAERICUS*, 332 aa. | 7.90E-45 | |
| | cg25321479 | 101 | AGAAAGTGTTG GCTCCAGGG TGGA[G/A]ATTC CCCGTGAGC | G | A | Ile | Ile | SILENT-CODING | transport | Human Gene Similar to TREMBLNEW-ID: E1245760 PUATIVE COBALT TRANSPORT PROTEIN - *STREPTOMYCES COELICOLOR*, 257 aa. | 9.80E-47 | |

| Seq ID | CuraGen sequence ID | Base pos. of SNP | Polymorphic sequence | Base before | Base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 69–70 | cg25321479 | 113 | CAGGAGCAGGG CTCCCAGGGT GGAGATTCCCC CGTG[A/G]GCC AGGAGCAGGG CCTGGAAGATG A | A | G | Ala | Ala | SILENT-CODING | transport | Human Gene Similar to TREMBLNEW-ID: E1245760 PUATIVE COBALT TRANSPORT PROTEIN - *STREPTOMYCES COELICOLOR*, 257 aa. | 9.80E-47 | |
| 71–72 | cg25321479 | 197 | GTTTGAACAGT GCCGCCCAA CTCC[C/T]GTTC CGGTGGGGTG CGAGGACGAT C | C | T | Thr | Thr | SILENT-CODING | transport | Human Gene Similar to TREMBLNEW-ID: E1245760 PUATIVE COBALT TRANSPORT PROTEIN - *STREPTOMYCES COELICOLOR*, 257 aa. | 9.80E-47 | |
| 73–74 | cg25321479 | 245 | ATCCCGTAACG CTGGGCAGTTT GAT[G/A]GCCG AGAGCACAAAG GTGAAAGCGC | G | A | Ala | Ala | SILENT-CODING | transport | Human Gene Similar to TREMBLNEW-ID: E1245760 PUATIVE COBALT TRANSPORT PROTEIN - *STREPTOMYCES COELICOLOR*, 257 aa. | 9.80E-47 | |
| 75–76 | cg25321479 | 35 | GCCACGTAGT TCTTGGTGAG CTT[A/G]TAAAA GGCGTACCCA GCCCACGGTC | A | G | Tyr | Tyr | SILENT-CODING | transport | Human Gene Similar to TREMBLNEW-ID: E1245760 PUATIVE COBALT TRANSPORT PROTEIN - *STREPTOMYCES COELICOLOR*, 257 aa. | 9.80E-47 | |
| 77–78 | cg25321479 | 38 | CACGTAGTTTC TTGGTGAGCTT ATA[A/G]AAGG CGTACCCAGC CCACGGTCCC G | A | G | Phe | Phe | SILENT-CODING | transport | Human Gene Similar to TREMBLNEW-ID: E1245760 PUATIVE COBALT TRANSPORT PROTEIN - *STREPTOMYCES COELICOLOR*, 257 aa. | 9.80E-47 | |
| 79–80 | cg25321479 | 83 | GTCCCGCGATA GCCATCGAGAA AG[G/A]TTGG CTCCCAGGGT GGAGATTCCCC | G | A | Asn | Asn | SILENT-CODING | transport | Human Gene Similar to TREMBLNEW-ID: E1245760 PUATIVE COBALT TRANSPORT PROTEIN - *STREPTOMYCES COELICOLOR*, 257 aa. | 9.80E-47 | |
| 81–82 | cg25321479 | 14 | ACGCGTCAGG CCC[A/G]CGTA GTTCTTGGTG AGCTTATAAA | A | G | | | SILENT-NONCODING | transport | Human Gene Similar to TREMBLNEW-ID: E1245760 PUATIVE COBALT TRANSPORT PROTEIN - *STREPTOMYCES COELICOLOR*, 257 aa. | 9.80E-47 | |
| 83–84 | cg25321479 | 17 | ACGCGTCAGG CCCACG[T/A]A GTTCTTGGTG AGCTTATAAAA GG | T | A | | | SILENT-NONCODING | transport | Human Gene Similar to TREMBLNEW-ID: E1245760 PUATIVE COBALT TRANSPORT PROTEIN - *STREPTOMYCES COELICOLOR*, 257 aa. | 9.80E-47 | |
| 85–86 | cg39548335 | 298 | CTTCTGTATTC | G | A | Ala | Ala | SILENT- | UNCLASSI- | Human Gene Similar to SWISSPROT-ACC: P43618 | 2.90E-48 | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 87–88 | cg43335190 | 341 | TCGTTGTTACC GGC[G/A]GCCT TCCTGGGAGT GCTCATTATTC GTAGTTCATAT CTATTTACTTTT GC[C/T]TACATA CGATTACATAC ACGATTGG | C | T | | | CODING SILENT-NONCODING | UNCLASSI-FIED | HYPOTHETICAL 41.3 KD PROTEIN IN SAP155-YMR31 INTERGENIC REGION - *Saccharomyces cerevisiae* (Baker's yeast), 361 aa. Human Gene Similar to SWISSNEW-ACC: P32803 ENDOSOMAL P24B PROTEIN PRECURSOR (24 KD ENDOMEMBRANE PROTEIN) (BASIC 24 KD LATE ENDOCYTIC INTERMEDIATE COMPONENT) - *Saccharomyces cerevisiae* (Baker's yeast), 203 aa. | 7.60E-48 | |
| 89–90 | cg43335190 | 411 | AATTCTCGGTT TCATACTTTTTA CC[T/C]TGATCC TTCCACTGTTT TTCCCTGT | T | C | | | SILENT-NONCODING | UNCLASSI-FIED | Human Gene Similar to SWISSNEW-ACC: P32803 ENDOSOMAL P24B PROTEIN PRECURSOR (24 KD ENDOMEMBRANE PROTEIN) (BASIC 24 KD LATE ENDOCYTIC INTERMEDIATE COMPONENT) - *Saccharomyces cerevisiae* (Baker's yeast), 203 aa. | 7.60E-48 | |
| 91–92 | cg43298420 | 625 | GGTGACCGTG GTCTGAAAGAA GGCT[G/T]GGT TGAACTGGTAC AGCTTCAGGAC | G | T | Pro | Pro | SILENT-CODING | UNCLASSI-FIED | Human Gene Similar to TREMBLNEW-ACC: MD27784 PTD001 - *HOMO SAPIENS* (HUMAN), 218 aa. | 5.30E-47 | |
| 93–94 | cg44928880 | 161 | ACTGAGGTTGG GTTTCAGACCA AGA[C/T]ACTG GATTCTCCTAG TTAAGATAAA | C | T | | | SILENT-NONCODING | UNCLASSI-FIED | Human Gene Similar to SPTREMBL-ACC: O17549 M18.8 PROTEIN - *CAENORHABDITIS ELEGANS*, 447 aa. | 5.30E-47 | |
| 95–96 | cg39410689 | 99 | ATCACCACCAC CGCCACCACC ATCA[C/T]ACGG AAGATGCTCCT GCACCTAAGA | C | T | His | His | SILENT-CODING | UNCLASSI-FIED | Human Gene Similar to SWISSPROT-ACC: P43638 MAP-HOMOLOGOUS PROTEIN 1 - *Saccharomyces cerevisiae* (Baker's yeast), 1398 aa. | 5.50E-46 | |
| 97–98 | cg20297086 | 176 | TGCACGACAAG TACCCGGAGCT GAA[T/C]GAGG AGTGCCGTTC GACCAGATCG | T | C | Asn | Asn | SILENT-CODING | UNCLASSI-FIED | Human Gene Similar to SPTREMBL-ACC: P95543 ELONGATION FACTOR TU1 - *PLANOBISPORA ROSEA*, 397 aa. | 9.00E-45 | |
| 99–100 | cg20297086 | 239 | AGGAGCGTCA GCGCGGCATC ACCAT[C/T]CG ATCGCCACAT CGAGTACCAGA | C | T | Ile | Ile | SILENT-CODING | UNCLASSI-FIED | Human Gene Similar to SPTREMBL-ACC: P95543 ELONGATION FACTOR TU1 - *PLANOBISPORA ROSEA*, 397 aa. | 9.00E-45 | |
| 101–102 | cg20297086 | 248 | AGCGCGGCAT CACCATCTCGA TCGC[C/T]CACA TCGAGTACCAG | C | T | Ala | Ala | SILENT-CODING | UNCLASSI-FIED | Human Gene Similar to SPTREMBL-ACC: P95543 ELONGATION FACTOR TU1 - *PLANOBISPORA ROSEA*, 397 aa. | 9.00E-45 | |

TABLE 1-continued

| Seq ID | CuraGen sequence ID | Base pos. of SNP | Polymorphic sequence | Base before | Base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 103–104 | cg39386301 | 1177 | ACCGAGAAGC TATGTTAATGG TGAAGAAATTC ACC[T/C]CCGA CCGTGGTATGT CAATGTGAGA | T | C | | | SILENT-NONCODING | UNCLASSI-FIED | Human Gene Similar to SWISSPROT-ACC: P32612 PAU2 PROTEIN - *Saccharomyces cerevisiae* (Baker's yeast), 120 aa. | 1.00E-43 | |
| 105–106 | cg39386301 | 958 | ATAATGATAAA ATAGTTCGTTC ATA[T/C]ACTCC GGTGGGATCAT TGCAGAAAT | T | C | | | SILENT-NONCODING | UNCLASSI-FIED | Human Gene Similar to SWISSPROT-ACC: P32612 PAU2 PROTEIN - *Saccharomyces cerevisiae* (Baker's yeast), 120 aa. | 1.00E-43 | |
| 107–108 | cg39515238 | 192 | TCAAGATCTAT ATTGCACACCA GAG[C/A]TGTT GTTTTATACTA CAACTCATCT | C | A | | | SILENT-NONCODING | UNCLASSI-FIED | Human Gene Similar to SWISSPROT-ACC: P53845 HYPOTHETICAL 35.5 KD PROTEIN IN PIK1-POL2 INTERGENIC REGION - *Saccharomyces cerevisiae* (Baker's yeast), 314 aa. | 3.60E-40 | |
| 109–110 | cg29693502 | 181 | CAGCGGGGTA GCGCACCTGAT CGAC[G/A][TAT T CCAACAGCTCA TTCGTCAACT | G | A | Tyr | Tyr | SILENT-CODING | UNCLASSI-FIED | Human Gene Similar to SWISSPROT-ACC: Q10379 PROBABLE GLUTAMATE-AMMONIA-LIGASE ADENYLYLTRANSFERASE (EC 2.7.7.42) (GLUTAMINE-SYNTHETASE ADENYLYLTRANSFERASE) (ATASE) - Mycobacterium | 3.00E-39 | |
| 111–112 | cg29693502 | 226 | TCAACTCCCGG TCGCCGGCAC CGTG[A/G]CTA GCCCGCAGCA GGGCCTGGGA TT | A | G | Ser | Ser | SILENT-CODING | UNCLASSI-FIED | Human Gene Similar to SWISSPROT-ACC: Q10379 PROBABLE GLUTAMATE-AMMONIA-LIGASE ADENYLYLTRANSFERASE (EC 2.7.7.42) (GLUTAMINE-SYNTHETASE ADENYLYLTRANSFERASE) (ATASE) - Mycobacterium | 3.00E-39 | |
| 113–114 | cg29693502 | 319 | CCAGGCTCCG TACCATCGGAC CGGA[T/C]CGG CCTTCCGGGC GCAGATCGGC AT | T | C | Arg | Arg | SILENT-CODING | UNCLASSI-FIED | Human Gene Similar to SWISSPROT-ACC: Q10379 PROBABLE GLUTAMATE-AMMONIA-LIGASE ADENYLYLTRANSFERASE (EC 2.7.7.42) (GLUTAMINE-SYNTHETASE ADENYLYLTRANSFERASE) (ATASE) - Mycobacterium | 3.00E-39 | |
| 115–116 | cg29693502 | 385 | GGTCCGCCGCC GTGTTTGCCGA GCAG[G/A]TTG CGTAGCTTAGT GACGATTTTCA | G | A | Asn | Asn | SILENT-CODING | UNCLASSI-FIED | Human Gene Similar to SWISSPROT-ACC: Q10379 PROBABLE GLUTAMATE-AMMONIA-LIGASE ADENYLYLTRANSFERASE (EC 2.7.7.42) (GLUTAMINE-SYNTHETASE ADENYLYLTRANSFERASE) (ATASE) - Mycobacterium | 3.00E-39 | |
| 117–118 | cg29693502 | 388 | CCGCGCCGTG TTTGCCGAGCA GGTT[G/A]CGT AGCTTAGTGAC GATTTTCAGCG | G | A | Arg | Arg | SILENT-CODING | UNCLASSI-FIED | Human Gene Similar to SWISSPROT-ACC: Q10379 PROBABLE GLUTAMATE-AMMONIA-LIGASE ADENYLYLTRANSFERASE (EC 2.7.7.42) (GLUTAMINE-SYNTHETASE ADENYLYLTRANSFERASE) (ATASE) - Mycobacterium | 3.00E-39 | |

TABLE 1-continued

| Seq ID | CuraGen sequence ID | Base pos. of SNP | Polymorphic sequence | Base before | Base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 119–120 | cg29693502 | 397 | GTTTGCCGAGC AGGTTGCGTAG CTT[A/G]TGAC GATTTTCAGCG CCTTCTCCC | A | G | Thr | Thr | SILENT-CODING | UNCLASSI-FIED | Mycobacterium Human Gene Similar to SWISSPROT-ACC: Q10379 PROBABLE GLUTAMATE-AMMONIA-LIGASE ADENYLYLTRANSFERASE (EC 2.7.7.42) (GLUTAMINE-SYNTHETASE ADENYLYLTRANSFERASE) (ATASE) - Mycobacterium | 3.00E-39 | |
| 121–122 | cg29693502 | 403 | CGAGCAGGTT GCGTAGCTTAG TGAC[G/A]ATTT TCAGCGCCTTC TCCCGACTC | G | A | Ile | Ile | SILENT-CODING | UNCLASSI-FIED | Human Gene Similar to SWISSPROT-ACC: Q10379 PROBABLE GLUTAMATE-AMMONIA-LIGASE ADENYLYLTRANSFERASE (EC 2.7.7.42) (GLUTAMINE-SYNTHETASE ADENYLYLTRANSFERASE) (ATASE) - Mycobacterium | 3.00E-39 | |
| 123–124 | cg43935044 | 511 | GAGTCTGGGG CTGGCTGGGC TTCTG[G/T]CTG TCCTCTGTCGC CGGATGGGCT C | G | T | | | SILENT-NONCODING | UNCLASSI-FIED | Human Gene Similar to SPTREMBL-ACC: P70429 ENA-VASODILATOR STIMULATED PHOSPHO-PROTEIN (ENA-VASP LIKE PROTEIN) - MUS MUSCULUS (MOUSE), 393 aa. | 3.50E-39 | |
| 125–126 | cg27850036 | 116 | TGAATGGTGGC AGACCGGCGT AGGT[G/A]TCTA GCCAGTCCATG TCACCGTAGA | G | A | Asp | Asp | SILENT-CODING | UNCLASSI-FIED | Human Gene Similar to SWISSNEW-ACC: P11653 METHYLMALONYL-COA MUTASE ALPHA-SUBUNIT (EC 5.4.99.2) (MCM-ALPHA) - Propionibacterium freudenreichii shermanii, 727 aa. | 1.00E-38 | |
| 127–128 | cg27850036 | 14 | ACGCGTTGGA CTC[T/C]TTAGC GGTGGAGAAT CCGGCGTACT | T | C | Lys | Lys | SILENT-CODING | UNCLASSI-FIED | Human Gene Similar to SWISSNEW-ACC: P11653 METHYLMALONYL-COA MUTASE ALPHA-SUBUNIT (EC 5.4.99.2) (MCM-ALPHA) - Propionibacterium freudenreichii shermanii, 727 aa. | 1.00E-38 | |
| 129–130 | cg27850036 | 41 | TAGCGGTGGA GAATCCGGCG TACTG[G/A]CG AATCGTCCACG GCCGGAAGGC AT | G | A | Arg | Arg | SILENT-CODING | UNCLASSI-FIED | Human Gene Similar to SWISSNEW-ACC: P11653 METHYLMALONYL-COA MUTASE ALPHA-SUBUNIT (EC 5.4.99.2) (MCM-ALPHA) - Propionibacterium freudenreichii shermanii, 727 aa. | 1.00E-38 | |
| 131–132 | cg42331882 | 466 | TGTGCGTAGG GAAAGTCAGTG TCGT[G/A]CAG CTCCAGGAG CCTCCTGAGC GT | G | A | | | SILENT-NONCODING | UNCLASSI-FIED | Human Gene Similar to SPTREMBL-ACC: Q15407 RTSBETA - HOMO SAPIENS (HUMAN), 416 aa. | 1.10E-37 | 18 |
| 133–134 | cg43945926 | 203 | ACAACGCGAG CCAGGAGTACT ACAC[A/G]GCG CTCATCAACGT GACGGTGCAG | A | G | | | SILENT-NONCODING | UNCLASSI-FIED | Human Gene Similar to SWISSPROT-ACC: Q06003 GOLIATH PROTEIN (GI PROTEIN) - Drosophila melanogaster (Fruit fly), 284 aa. | 1.10E-37 | |

TABLE 1-continued

| Seq ID | CuraGen sequence ID | Base pos. of SNP | Polymorphic sequence | Base before | Base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 135–136 | cg39575634 | 12 | AGATCTGGGAC[A/G]ATGTCTGGGGAAGTGCCACCCAACAG | A | G | Thr | Thr | SILENT-CODING | UNCLASSIFIED | Human Gene Similar to SPTREMBL-ACC: Q63965 TRICARBOXYLATE CARRIER - *RATTUS NORVEGICUS* (RAT), 357 aa (fragment). | 3.00E-37 | |
| 137–138 | cg39575634 | 120 | TCTTCACGGTTACTGATCCCAGAAA[C/T]ATCCTTTTAACGAACGAACAGCTAG | C | T | Asn | Asn | SILENT-CODING | UNCLASSIFIED | Human Gene Similar to SPTREMBL-ACC: Q63965 TRICARBOXYLATE CARRIER - *RATTUS NORVEGICUS* (RAT), 357 aa (fragment). | 3.00E-37 | |
| 139–140 | cg39575634 | 165 | AGCTAGAGAATGCGAGGAAAGTGG[T]A/G]CACGATTACAGGCAAGGAATCGTTC | A | G | Val | Val | SILENT-CODING | UNCLASSIFIED | Human Gene Similar to SPTREMBL-ACC: Q63965 TRICARBOXYLATE CARRIER - *RATTUS NORVEGICUS* (RAT), 357 aa (fragment). | 3.00E-37 | |
| 141–142 | cg39575634 | 214 | TCCTGCCGGCCTCACGGAAAATGAG[T/C][T]ATGGAGAGCGAAGTACGCGT | T | C | Leu | Leu | SILENT-CODING | UNCLASSIFIED | Human Gene Similar to SPTREMBL-ACC: Q63965 TRICARBOXYLATE CARRIER - *RATTUS NORVEGICUS* (RAT), 357 aa (fragment). | 3.00E-37 | |
| 143–144 | cg27826036 | 118 | GTAGGGCGACGGCGTATTTATGTCC[C/T]TCGCCAAGCACGACAGCGTTAGACA | C | T | Glu | Glu | SILENT-CODING | UNCLASSIFIED | Human Gene Similar to SWISSPROT-ACC: Q10776 PUTATIVE LONG-CHAIN-FATTY-ACID--COA LIGASE (EC 6.2.1.3) (LONG-CHAIN ACYLCOA SYNTHETASE) (LACS) - | 3.40E-36 | |
| 145–146 | cg27826036 | 163 | TAGACAGGTACGGGCAGTTGGCCAT[G/C]AGAGTGGCCTGACCTTCTGTGGG | G | C | Leu | Leu | SILENT-CODING | UNCLASSIFIED | Human Gene Similar to SWISSPROT-ACC: Q10776 PUTATIVE LONG-CHAIN-FATTY-ACID--COA LIGASE (EC 6.2.1.3) (LONG-CHAIN ACYLCOA SYNTHETASE) (LACS) - | 3.40E-36 | |
| 147–148 | cg42538578 | 207 | AGAGACATTGCCCTCCACTGCTGAC[G/A]CAATTGTAATGATCAGATCTGTGC | G | A | Cys | Cys | SILENT-CODING | UNCLASSIFIED | Human Gene Similar to SWISSPROT-ACC: Q09753 BETA-DEFENSIN 1 PRECURSOR (HBD-1) (DEFENSIN, BETA 1) - *Homo sapiens* (Human), 68 aa. | 7.40E-34 | 8 |
| 149–150 | cg42538578 | 365 | GGATTTCAGGAACTGGGGAGAGGCT[G/A]GCTCCTTTGAGGCTGAGCTGACAG | G | A | | | SILENT-NONCODING | UNCLASSIFIED | Human Gene Similar to SWISSPROT-ACC: Q09753 BETA-DEFENSIN 1 PRECURSOR (HBD-1) (DEFENSIN, BETA 1) - *Homo sapiens* (Human), 68 aa. | 7.40E-34 | 8 |
| 151–152 | cg44002673 | 1167 | AGCAAGCTCTTTGAAACCTGAGCCC[A/G]CGCA | A | G | | | SILENT-NONCODING | UNCLASSIFIED | Human Gene Similar to SWISSPROT-ACC: P32740 HYPOTHETICAL 31.0 KD PROTEIN R107.2 IN CHROMOSOME III - *Caenorhabditis elegans*, | 7.40E-34 | 13 |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 153–154 | cg39710199 | 535 | GACCAGAAGTAAACAGGCACCAGCCGGTGCGGCCTGAGGTGCGGGG[C/T]GGAGATGAGTGTCGTCATGTCAAT | C | T | | | SILENT-NONCODING | UNCLASSI-FIED | Human Gene Similar to TREMBLNEW-ACC: CAB50754 PUTATIVE INTEGRAL MEMBRANE TRANSPORT PROTEIN - STREPTOMYCES COELICOLOR, 269 aa. | 1.20E−33 | |
| 155–156 | cg39710199 | 736 | TGTGGGTAGTGAGCACGAGGAGAC[C/A]CCGTCATGACGCATTTGCTCAACGA | C | A | | | SILENT-NONCODING | UNCLASSI-FIED | Human Gene Similar to TREMBLNEW-ACC: CAB50754 PUTATIVE INTEGRAL MEMBRANE TRANSPORT PROTEIN - STREPTOMYCES COELICOLOR, 269 aa. | 1.20E−33 | |
| 157–158 | cg38821538 | 155 | ATCACCTGAGGTCCGGAGTTCAAGA[T/C]CAGCCTGGCCAACATGATGAAACCC | T | C | Asp | Asp | SILENT-CODING | UNCLASSI-FIED | Human Gene Similar to SWISSPROT-ACC: P39195 !!!! ALU SUBFAMILY SX WARNING ENTRY - Homo sapiens (Human), 591 aa. | 3.50E−33 | |
| 159–160 | cg21632104 | 261 | CGTCGCAGTACGTTCTGGCCTGTCA[A/G]CGTTTTGCATATCCCG | A | G | Leu | Leu | SILENT-CODING | UNCLASSI-FIED | Human Gene Similar to TREMBLNEW-ACC: CAB38487 PUTATIVE HELICASE - STREPTOMYCES COELICOLOR, 815 aa. | 3.00E−32 | |
| 161–162 | cg20370177 | 370 | CCCAAGCCAATACCAAGATGATCGC[A/C]ACTGGCATCATGTCTCCCATGCCTT | A | C | Val | Val | SILENT-CODING | UNCLASSI-FIED | Human Gene Similar to TREMBLNEW-ACC: CAB49211 HYPOTHETICAL 57.7 KD PROTEIN - PYROCOCCUS ABYSSI, 533 aa. | 1.50E−31 | |
| 163–164 | cg14810223 | 103 | CGAGCAGCCCGCCAGGACTCTGGCT[A/G]CTGGAGATGGGCGCCCGGCTATCGC | A | G | | | SILENT-NONCODING | | | | |
| 165–166 | cg19882105 | 125 | GAGATCAGTGTGATGATGCACAGGA[C/T]GGATGCGGGAATCCAGCTCTTCAT | C | T | | | SILENT-NONCODING | | | | |
| 167–168 | cg19882105 | 131 | AGTGTGATGATGCACAGGACGGATG[C/T]GGGAATCCCAGCTCTTCATATGGCT | C | T | | | SILENT-NONCODING | | | | |
| 169–170 | cg19885950 | 67 | TCCTCAAGTCT | G | T | | | SILENT- | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 171–172 | cg20452710 | 118 | TTGTTCAAATAT CA[G/T]CTTTTC AGCAAGACCTT CATTAACT TGGCCTGGAG AGAGGCGGGA GGGAC[A/G]CT GGCCTGGAGA GAGGCGGGAG GGA | A | G | | | NONCODING SILENT-NONCODING | | | | |
| 173–174 | cg20452710 | 64 | GACAGGGGAG AGAGGCGGGA GGGAC[A/G]CT GGCCTGGAGA GAGGCGGGAG GGA | A | G | | | SILENT-NONCODING | | | | |
| 175–176 | cg20454325 | 152 | ACATCCCTGCA CTGTCACCAGC CCG[A/G]CCCC TTGTACCATGG CAGGGTTGG | A | G | | | SILENT-NONCODING | | | | |
| 177–178 | cg20454325 | 159 | TGCACTGTCAC CAGCCCGACC CCTT[G/A]TACC ATGGCAGGGTT GGGCTGACTG | G | A | | | SILENT-NONCODING | | | | |
| 179–180 | cg20595730 | 225 | CTCCAAAGACT TGATTCCAAGA AAC[A/G]TCTGT GAAATTCACTA AGTTTAAGA | A | G | | | SILENT-NONCODING | | | | |
| 181–182 | cg20595730 | 247 | AACATCTGTGA AATTCACTAAG TTT[A/C]AGATA TGAAGAGACAG ACTAGTTAT | A | C | | | SILENT-NONCODING | | | | |
| 183–184 | cg20610793 | 156 | GGGCCGACCC GAGCAGATGT GTCGT[C/T]ATC GAGGACTCCG CTTTCGGATTG | C | T | | | SILENT-NONCODING | | | | |
| 185–186 | cg20610793 | 165 | CGAGCAGATGT GTCGTCATCGA GGA[C/T]CCG | C | T | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 187–188 | cg20610793 | 198 | CTTTCGGATTG CGTGCCGGAC TCGGATTGCGT GCCGGACGGG CTGC[C/T]GGA GCGTGGGTTCT CACGGTCGGA C | C | T | | | SILENT-NONCODING | | | | |
| 189–190 | cg20610793 | 228 | CGTGGGTTCTC ACGGTCGGAC GCAG[G/A]CTC AAGGGCCAGG GGGACATGTG GG | G | A | | | SILENT-NONCODING | | | | |
| 191–192 | cg20610793 | 237 | TCACGGTCGG ACGCAGGCTC AAGGG[C/A]CA GGGGACATG TGGGTTCCCG GGC | C | A | | | SILENT-NONCODING | | | | |
| 193–194 | cg20610793 | 267 | GGGACATGTG GGTTCCCGGG CTGGA[T/C]GAT GAGCGGGTGA CCTTCTGGGAA C | T | C | | | SILENT-NONCODING | | | | |
| 195–196 | cg20610793 | 284 | GGGCTGGATG ATGAGCGGGT GACCT[T/C]CTG GGAACCCCATC GATGAGGGCG T | T | C | | | SILENT-NONCODING | | | | |
| 197–198 | cg20610793 | 296 | GAGCGGGTGA CCTTCTGGGAA CCCC[A/G]TCG ATGAGGGCGT GCGAGCTGAC AC | A | G | | | SILENT-NONCODING | | | | |
| 199–200 | cg20610793 | 43 | CGGATTGGCCT CACAAGGCTG GCTG[A/G]AAC TGTTCGACACC GTCCTTGGGGT | A | G | | | SILENT-NONCODING | | | | |
| 201–202 | cg20711459 | 261 | CCCGACTGAA GGCACGGATG | A | G | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 203–204 | cg20723460 | 148 | AGTTC[A/G]CC GATCCCATATT TGGAGTGGAG AG TTCCCCGGCG AAGAAAAGGC GTCG[C/T]CCAT TCCTCTTCCAA AACGCTACAA | C | T | | | SILENT-NONCODING | | | | |
| 205–206 | cg20723460 | 193 | CTACAACAAAA ACCACCACGCT TCC[C/T]TTCCT TCTTCCTTGCC CCTTTCCCT | C | T | | | SILENT-NONCODING | | | | |
| 207–208 | cg20724182 | 184 | GATCATTGTAG GCTATTTCAAA ACC[G/A]CCAA ACAAGCCATGA ACGCAGCAAA | G | A | | | SILENT-NONCODING | | | | |
| 209–210 | cg20724182 | 197 | TATTTCAAAAC CGCCAAACAAG CCA[T/C]GAAC GCAGCAAAACA ATTCCACTGG | T | C | | | SILENT-NONCODING | | | | |
| 211–212 | cg20724182 | 95 | TGCTGGGGGC GCTTCACAGAC AACA[A/A]CAAA TACGCTGTAGC TGCCCAATAT | T | A | | | SILENT-NONCODING | | | | |
| 213–214 | cg20724182 | 99 | GGGGGCGCTT CACAGACAACA TCAA[A/G]TACG CTGTAGCTGCC CAATATTGAA | A | G | | | SILENT-NONCODING | | | | |
| 215–216 | cg20724478 | 247 | ACTATCTGGGA GTTGGGGCCC TGCA[C/T]GGC ACTGGAACCAA ACCTGAGGCT G | C | T | | | SILENT-NONCODING | | | | |
| 217–218 | cg20724478 | 250 | ATCTGGGAGTT GGGGCCCTGC ACGG[C/T]ACT GGAACCAAACC TGAGGCTGGG | C | T | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 219–220 | cg20724478 | 298 | GGGAGCTCGG CCTGGCTGGG ATACG[C/T]GAT GTCGTCAACGC CAGCCCGTGG C | C | T | | | SILENT-NONCODING | | | | |
| 221–222 | cg20724478 | 90 | GTTGCCGAAAT TGGGGCCGAT GGTG[C/T]CCA TGTTGGGCAGT CTGACATGCCG | C | T | | | SILENT-NONCODING | | | | |
| 223–224 | cg20726641 | 101 | TCAAGAAATTT GCCATTCTTGA CCA[C/T]GACCT GACCGAGGATT CTCACTCAG | C | T | | | SILENT-NONCODING | | | | |
| 225–226 | cg20726641 | 119 | TTGACCACGAC CTGACGAGG ATTC[T/A]CACT CAGTGACGAC CAGTCTCAAGG | T | A | | | SILENT-NONCODING | | | | |
| 227–228 | cg20726641 | 224 | CTGACGAAAAC GATCAACCGG GCGC[T/C]TCA AAGGGAAGCG ACGCTTCATGA C | T | C | | | SILENT-NONCODING | | | | |
| 229–230 | cg20726641 | 280 | CTGTCGTTCGTC GATATTCCACT GCG[C/T]TGGT CCGATATGGAT GCGCAGGGAC | C | T | | | SILENT-NONCODING | | | | |
| 231–232 | cg20726641 | 307 | GGTCCGATATG GATGCGCAGG GACA[T/C]GTTA ATAACGTTCGT ATTAGCGAAGC | T | C | | | SILENT-NONCODING | | | | |
| 233–234 | cg20726641 | 310 | CCGATATGGAT GCGCAGGGAC ATGT[T/C]AATA ACGTTCGTATT AGCGAGCTCG | T | C | | | SILENT-NONCODING | | | | |
| 235–236 | cg20726641 | 316 | TGGATGCGCA GGGACATGTTA | C | T | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 237–238 | cg20728487 | 53 | ATAA[C/T]GTTC GTATTAGCGAG CTCGAACA | T | C | | | SILENT-NONCODING | | | | |
| 239–240 | cg20730743 | 23 | GGAAACTCATC GGCAATATCGT TGC[T/C]GCTTG GGAGACTGGC TTCATGCTGG | A | G | | | SILENT-NONCODING | | | | |
| 241–242 | cg20730743 | 26 | ACGCGTACTG GCGGATCTCA GT[A/G]CGATAA CCCACCAGATT GCCGGTGA | A | G | | | SILENT-NONCODING | | | | |
| 243–244 | cg20730743 | 95 | ACGCGTACTG GCGGATCTCA GTACG[A/G]TAA CCCACCAGATT GCCGGTGAAC T | A | G | | | SILENT-NONCODING | | | | |
| 245–246 | cg20744814 | 84 | GCTGTCCGGC CCCACCGGCG AGTTT[A/G]TCG AGCTGGGAGG GATCGATTTTC C | C | gap | | | SILENT-NONCODING | | | | |
| 247–248 | cg21147609 | 219 | GGCACCCGGG TGCTGCTGGC CATGG[C/gap]C ACCCACGAAG CTCTCCCTGCC CCC | C | T | | | SILENT-NONCODING | | | | |
| 249–250 | cg21147791 | 282 | GTTCCATGCCT TTCTAGACCCC AGG[C/T]CCTTT CCTGCATGATT TTATCAGCA | G | A | | | SILENT-NONCODING | | | | |
| 251–252 | cg21148047 | 203 | AATAAAGTGTT TCCTTGAGTCC TGT[G/A]AGTTG CTCTAGCAAAT TTATCAATC | A | G | | | SILENT-NONCODING | | | | |
| | | | ATGGTGATTCC TCAAGAAATTA GAA[A/G]CAGA ATTACCCTATG | | | | | | | | | |

TABLE 1-continued

| Seq ID | CuraGen sequence ID | Base pos. of SNP | Polymorphic sequence | Base before | base after | Amino acid before | Amino acid after | Type of change | Protein classification of Name of protein identified following a BLASTX analysis of the CuraGen sequence | BLASTX analysis | Similarity (pValue) following a location | Map |
|---|---|---|---|---|---|---|---|---|---|---|---|---|
| 253–254 | cg21148203 | 236 | ATCCAGCATT TATGTTTGCTG GGGGAGTGGG TGGG[T/C]TGC AGAACTTAAGA CCAGGACAATT | T | C | | | SILENT-NONCODING | | | | |
| 255–256 | cg21150589 | 135 | CCTTTGAAATT CGATTTCCTTC CCC[A/G]GGTG AAAGAGGAGAA CAGATTCTAC | A | G | | | SILENT-NONCODING | | | | |
| 257–258 | cg21395558 | 63 | ATTGACAGAGT GACATTTGGGC AAC[G/T]CGTG AAGGAAGTGG GTGGAGGAGG T | G | T | | | SILENT-NONCODING | | | | |
| 259–260 | cg21395558 | 65 | TGACAGAGTGA CATTTGGGCAA CGC[G/T]TGAA GGAAGTGGGT GGAGGAGGTG G | G | T | | | SILENT-NONCODING | | | | |
| 261–262 | cg21395558 | 72 | GTGACATTTGG GCAACGCGTG AAGG[A/G]AGT GGGTGGAGGA GGTGGCAGCC AG | A | G | | | SILENT-NONCODING | | | | |
| 263–264 | cg21415668 | 138 | AGGACTGGTCA GGGAGGAGTT AGGG[C/G]AGG AGGACTGGTCA GGGAGGAGTT A | C | G | | | SILENT-NONCODING | | | | |
| 265–266 | cg21417734 | 43 | CAACGGGTTAC CCGGGCGCAC CTGG[C/G]TTT GCCGATCACA GCGGCACGCA | C | G | | | SILENT-NONCODING | | | | |
| 267–268 | cg21428517 | 142 | CCATGCCCATC CCGGTGCCGC AGAA[A/G]AAG ATTCCTCGATC T | A | G | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 269–270 | cg21428762 | 113 | GGCTTTTCCGT TGGTCGTGGTC TCATCAGAGGT GAA[A/G]ACGA TGAGCGGGGT GCTCGGACGC A | A | G | | | SILENT-NONCODING | | | | |
| 271–272 | cg21428762 | 149 | GGGTGCTCGG ACGCAGACGA GCGAT[A/G]CG ACGGGCGGTG TCACCGGACTT GG | A | G | | | SILENT-NONCODING | | | | |
| 273–274 | cg21428762 | 65 | ACACCGGGGT AACGACGGCG TGAGC[G/A]CC CCAGACCCAG GCGAGGGTCT TGG | G | A | | | SILENT-NONCODING | | | | |
| 275–276 | cg21429119 | 356 | TTGGTAGGCCA AGGCAGGACG ACCA[C/T]TTGA GCCTGGGAATT TGAAACCAGC | C | T | | | SILENT-NONCODING | | | | |
| 277–278 | cg21429119 | 393 | AATTTGAAACC AGCCTGGGCA ACAT[A/G]TGA GTCTTTGTTTC TACAAGAAAT | A | G | | | SILENT-NONCODING | | | | |
| 279–280 | cg21429119 | 408 | TGGGCAACATA GTGAGTCTTTG TTT[C/T]TACAA GAAATTTAAAA AAAAATTA | C | T | | | SILENT-NONCODING | | | | |
| 281–282 | cg21429803 | 373 | TGCACCCGGC GTGCCCTGAAA CACA[C/T]GCG TGTGCCCGAA ATACCTGCATT | C | T | | | SILENT-NONCODING | | | | |
| 283–284 | cg21433543 | 205 | GGTGGATCTG GTCGGGATCG GTGAC[C/T]ACT CTGGTCATCGT CGATTATGCGA | C | T | | | SILENT-NONCODING | | | | |
| 285–286 | cg21433543 | 239 | CATCGTCGATT | C | T | | | SILENT- | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| | | | ATGCGACGAC CTTC[C/T]TACC ACTGAAGTTAT GGCGTCGCTG | | | | | NONCODING | | | | |
| 287–288 | cg21433543 | 269 | ACTGAAGTTAT GGCGTCGCTG CGTA[G/gap]CC GAGGCTGGGG TAGCGCTCCTG GG | G | gap | | | SILENT-NONCODING | | | | |
| 289–290 | cg21433543 | 293 | AGCCGAGGCT GGGGTAGCGC TCCTG[G/A]GC GGAATCGTCCT GACGCGGCCG CC | G | A | | | SILENT-NONCODING | | | | |
| 291–292 | cg21435199 | 96 | AAATTTAATAAAA TAAATTATAAA GA[G/A]CTCCT CTTACCTAGAA ATAATTATT | G | A | | | SILENT-NONCODING | | | | |
| 293–294 | cg21637172 | 37 | CGGTTGGCCA AGCCTGGCACT CAAA[C/T]GTCC GCCTAACCTGG GGTCTTTATT | C | T | | | SILENT-NONCODING | | | | |
| 295–296 | cg21643872 | 325 | GGTTGAGTGG GACGCCTTCTA CGAG[A/G]AGC ACCCTGAGCTT GACCTGGAAA G | A | G | | | SILENT-NONCODING | | | | |
| 297–298 | cg21657573 | 102 | AAAAAGGTTAA AGATCAGACAG ACA[G/C]CTGA CCTTACTGCCC TCAATGGCCA | G | C | | | SILENT-NONCODING | | | | |
| 299–300 | cg21657879 | 270 | CCAGGGAAAG CCAGTCCCCT CCCC[C/G]ACA GCAGTCACGAA CCTCAGAAGCC | C | G | | | SILENT-NONCODING | | | | |
| 301–302 | cg21659205 | 482 | CCAAACAATCC AGCTTGCTCCC CTC[G/A]ACCA | G | A | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 303–304 | cg21660634 | 198 | CTCAGAACAAA CGCCCTAAGT CCACGTGACG ACCGGAACATC ACTG[T/C]GAC GCTTCACTCGG GCAACCGGTC | T | C | | | SILENT-NONCODING | | | | |
| 305–306 | cg21660634 | 92 | GCCACGGCTC GGTGAATCCGA CTCG[C/T]GGG GCCAACACAAC GGCCTCACCC A | C | T | | | SILENT-NONCODING | | | | |
| 307–308 | cg21661814 | 164 | CGCCGAAATC GGTGACGATG GCCTT[C/G]GC GTGGCCAATGT GGAGGTAGCC GT | C | G | | | SILENT-NONCODING | | | | |
| 309–310 | cg21661814 | 239 | GGACGCGCCC GCCGTAGGTG TCCTG[T/G]TG GATGTCCGCG CGMCAACCTG AT | T | G | | | SILENT-NONCODING | | | | |
| 311–312 | cg21661814 | 29 | CGTGGACAAC GTGGGCCGGG GAGTA[G/A]CC TAACCACTCAA TGTCTGCAATG A | G | A | | | SILENT-NONCODING | | | | |
| 313–314 | cg21661814 | 52 | TAGCCTAACCA CTCAATGTCTG CAA[T/C]GATCG ACTGACATAC TCGGTTTCC | T | C | | | SILENT-NONCODING | | | | |
| 315–316 | cg21661814 | 98 | TTTCCTCGGTG CCTGATTAGT ATC[A/G][TCAAG TCTCAGGTTGC AGGTGCCGC | A | G | | | SILENT-NONCODING | | | | |
| 317–318 | cg24113982 | 145 | GCTCGGCTGC TGCAGAAGTCT CCTT[C/T]CCTC | C | T | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 319–320 | cg25268133 | 209 | CTTTGTGCTG GTATATAGAA GGCCGTCATC GCGGTCACGA CTCCC[G/A]TG ATCACCATGAT CGTGGGCATG AC | G | A | | | SILENT-NONCODING | | | | |
| 321–322 | cg25309388 | 332 | TGAGAGGGTAA AGTGCCAGTCT GTG[C/T]TAAAA GAACGTGAAAA GGAAACCTA | C | T | | | SILENT-NONCODING | | | | |
| 323–324 | cg25339094 | 215 | TTGCCCAGACC AATGGGATGG GTCG[T/C]CTC CGCCACCATC GAGAAACGAG AA | T | C | | | SILENT-NONCODING | | | | |
| 325–326 | cg25339094 | 345 | TGCGAGCCTG CACACCAACAA CCCC[C/A]AGA TCGGCGAGTC GACCTCTCATC G | C | A | | | SILENT-NONCODING | | | | |
| 327–328 | cg25339094 | 351 | CCTGCACACCA ACAACCCCCAG ATC[G/A]GCGA GTCGACCTCTC ATCGTGCCAG | G | A | | | SILENT-NONCODING | | | | |
| 329–330 | cg27778388 | 118 | GTCCCAGGGT GACGCGAGGT TGGGG[A/G]CT GAGCAACCAG GAATAGACCTT CA | A | G | | | SILENT-NONCODING | | | | |
| 331–332 | cg27802892 | 239 | ATCTAACCGGT TCTAGACAGCT TAA[A/G]CAAAC AGATACAGTGC CCTTTTCTC | A | G | | | SILENT-NONCODING | | | | |
| 333–334 | cg27802892 | 241 | CTAACCGGTTC TAGACAGCTTA AAC[A/C]AACA GATACAGTGCC | A | C | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 335–336 | cg27805688 | 354 | CTTTTCTCAG AATCCCGTTGC TGTCGTGATGT GAA[A/G]CCAG CACCAGTTCTG CTGGCCACGC | A | G | | | SILENT-NONCODING | | | | |
| 337–338 | cg27825173 | 254 | GGCCACCGCG GGCACCGCAC GGACA[C/T]CC CGACACACGA GCACCCACAC CCC | C | T | | | SILENT-NONCODING | | | | |
| 339–340 | cg27827050 | 71 | CCGATGGCAA GTGGGACAGC CTGGA[G/A]GG CTTGCTCACCT GCGAGCCCGG CC | G | A | | | SILENT-NONCODING | | | | |
| 341–342 | cg27828294 | 111 | GTACAAAAACT AGTAGATGTGT GAA[T/C]GCAAT AAAAGTGCTCA GAAACACAC | T | C | | | SILENT-NONCODING | | | | |
| 343–344 | cg27845127 | 25 | ACGCGTCCTGA AGCCGCCGAC GCG[A/G]CGAG AACAGCAGGC CAGCAGCTCG A | A | G | | | SILENT-NONCODING | | | | |
| 345–346 | cg27845127 | 78 | TCAGTGGCAGA TAGCCAGCGG CGAC[T/C]GAG CGTGCGCCAT GATGCCGCGA CT | T | C | | | SILENT-NONCODING | | | | |
| 347–348 | cg27845127 | 95 | GCGGCGACTG AGCGTGCGCC ATGAT[G/A]CC GCGACTGACA CCACCTGCGG TCC | G | A | | | SILENT-NONCODING | | | | |
| 349–350 | cg27922064 | 325 | CAAAAATGCTC ATTTAGTTTTCCT CA[A/G]CACCC CCAGACTGACC | A | G | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 351–352 | cg27923117 | 11 | TTCAAAACT GCTAGCAGCT [C/G]TGGCCCTG CAGCTGAGCA CAGGCCA | C | G | | | SILENT-NONCODING | | | | |
| 353–354 | cg27923117 | 160 | TATTCAGTAGG GAAAAGGGCA AGGA[C/T]CTG AAAAAGTGTA TTAAGAATCGT | C | T | | | SILENT-NONCODING | | | | |
| 355–356 | cg27929704 | 206 | GTCACTGGGC CTGATGCCACC GGAG[G/gap]CT GAGCTACTGG GCACCTTCGG CCA | G | gap | | | SILENT-NONCODING | | | | |
| 357–358 | cg27956615 | 73 | TTCTCCATGCT CCTAGATGGAA AAC[A/G]CAGT CATTCTGATCA CTTTCTCTCT | A | G | | | SILENT-NONCODING | | | | |
| 359–360 | cg27957329 | 105 | GGAGCTATGGT TTTCGCCAAGT CAA[C/T]TCACT GATTGTGGGAC GGGTGGTGG | C | T | | | SILENT-NONCODING | | | | |
| 361–362 | cg27962799 | 121 | TGCTCCTCCCG CGTGCTTCCGC CGC[C/T]GGTG GCTTGGACCC GTCGGGGCTG | C | T | | | SILENT-NONCODING | | | | |
| 363–364 | cg28315794 | 188 | GGTTTAGGAAT GCTAGCTTTTG AAA[C/T]TTCAT TCAAAATGTCT TTGAAGCCA G | C | T | | | SILENT-NONCODING | | | | |
| 365–366 | cg28389525 | 109 | TCGTGTTAGAA AACTTTCGACC TGG[A/G]TCA CGAAGCGTTTG GGAGTGGATG | A | G | | | SILENT-NONCODING | | | | |
| 367–368 | cg28389525 | 145 | GTTTGGGAGTG GATGCGGAAA GTGT[A/G]CATA | A | G | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of Name of protein identified following a BLASTX analysis of the CuraGen sequence | BLASTX analysis | Similarity (pValue) following a location | Map |
|---|---|---|---|---|---|---|---|---|---|---|---|---|
| 369-370 | cg28389525 | 187 | AAACCAATCCGCGAATAATATGAATAATATACGCCAGCATTTCGGG[T/C]TTCGGTCAAGAGGGGCCGTTCCGAA | T | C | | | SILENT-NONCODING | | | | |
| 371-372 | cg28389525 | 91 | TCGTTGAGCATGCAGACGTCGTGTT[A/G]GAAAACTTTCGACCTGGAGTCACGA | A | G | | | SILENT-NONCODING | | | | |
| 373-374 | cg28397602 | 82 | CCTCTCTGCACGGCTGTGTGTGTGC[A/G]TGTCCATGCCTGTCCAGGTCAGGAC | A | G | | | SILENT-NONCODING | | | | |
| 375-376 | cg28459036 | 106 | GCGACGAGGGTACGACCGTCGGTAG[C/T]CGTGTAGATCATACGTCGGGGCCGG | C | T | | | SILENT-NONCODING | | | | |
| 377-378 | cg28459036 | 142 | ATACGTCGGGGCCGGGTGACGCGCC[A/G]GAGGGCTTGCTGTTCGGTGGCGGTC | A | G | | | SILENT-NONCODING | | | | |
| 379-380 | cg28459036 | 266 | ATCCCGATCCAAATCCAGCTAGACC[G/A]ACCATAATCGTCAATGCGATCACCA | G | A | | | SILENT-NONCODING | | | | |
| 381-382 | cg28459036 | 80 | AGGCGGCCAAGTCAGCGCAGGAGGC[C/G]GCGACGAGGGTACGACCGTCGGTAG | C | G | | | SILENT-NONCODING | | | | |
| 383-384 | cg28473092 | 278 | CACCCTCGAGCATCGTCACCTCGAT[G/A]CTAATTAGAGCCATGTGCCGATGAG | G | A | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 385–386 | cg28473092 | 376 | GGGGTGCGCC ATACCAACTCC CGAC[A/G]CAG GACACCCTCG CGGAAGTCGAT C | A | G | | | SILENT-NONCODING | | | | |
| 387–388 | cg28486260 | 209 | TATTATTTGCTA TTACCCAAGCT GT[A/G]GGGGC TGTCCATTTTTA TGCGAAGT | A | G | | | SILENT-NONCODING | | | | |
| 389–390 | cg29195033 | 109 | GTGCAGGCTAA TCCACGACATG TAT[T/C]GACTT CCGTCGCGGA TCTTGCCGCC | T | C | | | SILENT-NONCODING | | | | |
| 391–392 | cg29195033 | 333 | CAAGCCATTCA TCGCCGTGCG GACC[A/G]TAG TAACCGACCGC CGAACCATTGA | A | G | | | SILENT-NONCODING | | | | |
| 393–394 | cg29195033 | 339 | ATTCATCGCCG TGCGGACCATA GTA[A/G]CCGA CCGCCGAACC ATTGAGGAAGA | A | G | | | SILENT-NONCODING | | | | |
| 395–396 | cg29195033 | 348 | CGTGCGGACC ATAGTAACCGA CCGC[C/T]GAA CCATTGAGGAA GATCCTGCAGC | C | T | | | SILENT-NONCODING | | | | |
| 397–398 | cg29195033 | 368 | ACCGCCGAAC CATTGAGGAAG ATCC[T/G]GCA GCGGGCGAG GATGCTAAGGC G | T | G | | | SILENT-NONCODING | | | | |
| 399–400 | cg29195033 | 44 | ACGAGGTTCAC CGGCCCGCTC ATAG[T/C]GTCG TCAGTCAGAAT CTTCATCATT | T | C | | | SILENT-NONCODING | | | | |
| 401–402 | cg29195033 | 72 | CGTCAGTCAGA ATCTTCATCATT GC[C/T]GATAC | C | T | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 403–404 | cg29204207 | 203 | GTGATCGTGCAGGCTAATCCGACACTCCCCTCGACGCAGCCTCCG[G/T]AGCGGCGCGCACTCTCCAGAGGCCA | G | T | | | SILENT-NONCODING | | | | 14 (14q22) |
| 405–406 | cg29207528 | 213 | CGGGCCCGCCCTAGCCCTCCTCGAT[C/T]CAGCGTGGGGACGCCAGATCCACGT | C | T | | | SILENT-NONCODING | | | | |
| 407–408 | cg29207528 | 245 | GGGGACGCCAGATCCACGTGGAGAC[G/A]ACAGGGTGCCCCAGCGCCGTGGTCT | G | A | | | SILENT-NONCODING | | | | |
| 409–410 | cg29207528 | 254 | AGATCCACGTGGAGACGACAGGGTG[C/T]CCCAGCGCCGTGGTCTGGAATCCAC | C | T | | | SILENT-NONCODING | | | | |
| 411–412 | cg29207528 | 260 | ACGTGGAGACGACAGGGTGCCCCAG[C/T]GCCGTGGTCTGGAATCCACGCTCCT | C | T | | | SILENT-NONCODING | | | | |
| 413–414 | cg29207528 | 413 | GCGACCTCACCATGTCCACACGGAT[C/T]AGCGTCGAAACGTTGTGATCGCTGC | C | T | | | SILENT-NONCODING | | | | |
| 415–416 | cg29214234 | 79 | GACGCGTACCTGCCATCAGGATCCT[C/T]GTTTGTTTCTGAAGCAACCCCTTC | C | T | | | SILENT-NONCODING | | | | |
| 417–418 | cg29216983 | 91 | CCGTTGGGCCATACCGTCTCGTGA[T/C]CGA | T | C | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a BLASTX analysis | Map location |
|---|---|---|---|---|---|---|---|---|---|---|---|---|
| | | | GGAAGGCTCA ACGGAATGCAT T | | | | | | | | | |
| 419–420 | cg29234854 | 193 | GACGCTGTGC CGTGGGATTTC CTCA[A/G]CGA GGCTCAAGAG AGGCACGCGT CG | A | G | | | SILENT-NONCODING | | | | |
| 421–422 | cg29235319 | 75 | CACACACAC ACACACACACA CAC[G/A]CACG CACGCACGCA CGCACGCAAT G | G | A | | | SILENT-NONCODING | | | | |
| 423–424 | cg29242513 | 250 | TAACGGTTGAG TAACACATCAA AAC[A/C]CCGTT CGAGGTCAAG CCTGGCGTGT | A | C | | | SILENT-NONCODING | | | | |
| 425–426 | cg29254804 | 134 | TACTTCATTTTT TTTCCTATTTG CA[A/G]CAACCT GTAATGAGTAA CTGTATTA | A | G | | | SILENT-NONCODING | | | | |
| 427–428 | cg29345947 | 298 | TAGTGACAGGC GCAATGCACAC CGA[A/G]CGGG CGCAAACAGA GCAGCCACGC T | A | G | | | SILENT-NONCODING | | | | |
| 429–430 | cg29352964 | 401 | CGTCTTGCCCA TATTGACGCCC CGA[C/T]GCTG CTGTCGGTGTG GGGGAGTGAC | C | T | | | SILENT-NONCODING | | | | |
| 431–432 | cg29357657 | 392 | CATGTGAGGA GGCCGGCCAT GAGGT[C/T]GT CGTGCTGAAC GACCTATCCGC GG | C | T | | | SILENT-NONCODING | | | | |
| 433–434 | cg29360558 | 158 | CGTTTATTTAT GCTTTTTGGTTG GTTT[T/C]TCCTT | T | C | | | SILENT-NONCODING | | | | |

| Seq ID | CuraGen sequence ID | Base pos. of SNP | Polymorphic sequence | Base before | Base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 435–436 | cg29522548 | 137 | TGATAAATGCG GCCCTTGCT CCATAATCATT TCCAACTCTTT CAA[A/G]GTTTT TTTAAATTTCAG CTCAAAAT | A | G | | | SILENT-NONCODING | | | | |
| 437–438 | cg30177683 | 471 | GGCTCTATATC ATTGAAAACGA ATT[C/T]TCCAC GCAAAACCCAC TTCACACCA | C | T | | | SILENT-NONCODING | | | | |
| 439–440 | cg30377599 | 144 | TGAGGCATCTA AATTTTCACAT CCT[G/T]CCTGT GGAGCAGCAA GCTGAAGAAA | G | T | | | SILENT-NONCODING | | | | |
| 441–442 | cg30790712 | 273 | CAGCACCGTG GGGTCCAGGG TCCAC[T/C]GTC CACCAGGACCT ACTGCGTGGG G | T | C | | | SILENT-NONCODING | | | | |
| 443–444 | cg32119538 | 286 | TTCCCTAAATC CAAAGCGAGC AAAC[A/C]GGA GAGAGAAACC CTGAAAATGGG C | A | C | | | SILENT-NONCODING | | | | |
| 445–446 | cg32120712 | 608 | CTCAACAGGTG GTGCACTGGG ACCG[G/gap]CA GCGCCCGGG GTCCGCACG ACC | G | gap | | | SILENT-NONCODING | | | | |
| 447–448 | cg32128189 | 81 | TCAGCTTTATT ATAATCTTATG GGA[C/T]CATCA TCATGTATGTG GTCCACTGG | C | T | | | SILENT-NONCODING | | | | |
| 449–450 | cg32153241 | 106 | CGGTGCGGCA CCATTCCACCG CGAT[C/T]GAC CCGGCTCCGG TCCCGAGGTC | C | T | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 451–452 | cg32153241 | 121 | CCACCGGAT CGACCCGGCT CCGG[C/A]CC GAGGTCCCAC AGCAGTTGACC AG | C | A | | | SILENT-NONCODING | | | | |
| 453–454 | cg32153241 | 175 | TGGGCCGCAG GGCTGCCAGC GCGAC[A/G]GC TCGTACCGCGT GCTTGGTGATA A | A | G | | | SILENT-NONCODING | | | | |
| 455–456 | cg32153241 | 348 | AACGCGGGGT GGGGGAGCCG AAGCC[T/C]GT GTGACACAATC AAGGGGACTC GC | T | C | | | SILENT-NONCODING | | | | |
| 457–458 | cg32153241 | 44 | GGTACGTGCG TTGGCGGCCC GCTCA[A/G]CC TTGCGTTCTAG CCCGATCGCC CG | A | G | | | SILENT-NONCODING | | | | |
| 459–460 | cg32153241 | 55 | TGGCGGCCCG CTCAACCTTGC GTTC[T/C]AGCC CGATCGCCCG ACAGGTCGGG T | T | C | | | SILENT-NONCODING | | | | |
| 461–462 | cg32153241 | 76 | GTTCTAGCCCG ATCGCCCGACA GGT[C/T]GGGT CGGTGCGGCA CCATTCCACCG | C | T | | | SILENT-NONCODING | | | | |
| 463–464 | cg32153241 | 82 | GCCCGATCGC CCGACAGGTC GGGTC[G/A]GT GCGGCACCATT CCACCGCGAT | G | A | | | SILENT-NONCODING | | | | |
| 465–466 | cg32168828 | 367 | TAGGGCAACG CCAAGTTCGAA GACG[T/C]CCC CG | T | C | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 467–468 | cg32177197 | 596 | CCTGTGCTTTT CCGCCTCACTC TGACGAGAGTC CCCTGGGACG AGGG[G/A]AAG GAATGGAAAGC GGTGGGGTCG T | G | A | | | SILENT-NONCODING | | | | |
| 469–470 | cg32177197 | 716 | ATGTACCGTCC GTCCCCTTCCA CAT[A/G]ATCTG GAGGCCGTAC CAATCGGGTG | A | G | | | SILENT-NONCODING | | | | |
| 471–472 | cg32180618 | 404 | TGTGTGTGAAA ATCAGCACGGT GCG[C/T]GTGA GGGGCGGGCG CGCTTCTCACA | C | T | | | SILENT-NONCODING | | | | |
| 473–474 | cg33206207 | 74 | CAGGGATGAC GCCGCCATGA GTTGG[G/T]TG ACGTGGGCCT GCCGACTGTCT CC | G | T | | | SILENT-NONCODING | | | | |
| 475–476 | cg34715517 | 291 | TGATGCCTCAG CAAAAATTGT GCT[A/gap]AAA AAAAAACTGG AAGAAAAGTAC | A | gap | | | SILENT-NONCODING | | | | |
| 477–478 | cg35050153 | 456 | CGACTTGTTCA GCACCAGGAG GAGG[C/T]GCT GGCTGCTGTCA CTGGGGCTCT G | C | T | | | SILENT-NONCODING | | | | |
| 479–480 | cg35066497 | 449 | TGTCGATCTGA TCGGAGAACTT GCC[G/A]CCGG TCTTGTCGTCG ACAGTGTTGC | G | A | | | SILENT-NONCODING | | | | |
| 481–482 | cg35066497 | 469 | TTGCCGCCGG TCTTGTCGTCG ACAG[T/C]GTTG CCAGCCTTGTC GATGCCCTGC | T | C | | | SILENT-NONCODING | | | | |

TABLE 1-continued

| Seq ID | CuraGen sequence ID | Base pos. of SNP | Polymorphic sequence | Base before | Base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 483–484 | cg35068462 | 289 | GAGGACTCGG CCTGACGACG GTCAC[C/T]GTC ATTCATGACCT CGACTTGGCTG | C | T | | | SILENT-NONCODING | | | | |
| 485–486 | cg35341776 | 413 | TCAATTGCTTTT TGTCCGACATC TC[A/G]ACACT CTCTTCACCAT GACTCAGT | A | G | | | SILENT-NONCODING | | | | |
| 487–488 | cg36508718 | 517 | TGGAGCCCGG CGACAAACTTG ACAT[C/T]ACCG TGCATAGCGCC CTCAACGATG | C | T | | | SILENT-NONCODING | | | | |
| 489–490 | cg36517624 | 234 | GAACTGGCCC AGCCAAACTCT TCAA[G/A]CTGC TGCCTAAAGCC TGGGTTGGGG | G | A | | | SILENT-NONCODING | | | | |
| 491–492 | cg36517624 | 307 | TGATGGCTTCA AGCACGTCCC GCCA[G/A]CCT AGCCCCGTCA CAGTCATCACA T | G | A | | | SILENT-NONCODING | | | | |
| 493–494 | cg36517624 | 453 | CATTCTTTGAA GTGCTTTTTGA TGG[G/A]TACCT CAGGGGTATCA GCGACCGGG | G | A | | | SILENT-NONCODING | | | | |
| 495–496 | cg36517624 | 475 | TGGGTACCTCA GGGGTATCAG CGAC[C/T]GGG ATGCGAAGGTA GGTGATATCCT | C | T | | | SILENT-NONCODING | | | | |
| 497–498 | cg36618790 | 360 | GGCGAAGCAC CTGAGGTCAG GAGTT[C/T]GA GACCAGCCTG GCCAACATGAC AA | C | T | | | SILENT-NONCODING | | | | |
| 499–500 | cg37003369 | 306 | TCAGTTGATTT AAGGAATAAAA AAA[gap/A]GAC | gap | A | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 501–502 | cg37403369 | 404 | CATTTTGCTAA ACACTATTAAA TGTGACCTGTG TTCATAGCTAA CA[TG/A]AGCTC TGACCTCCCTA CGCCGGGCG | G | A | | | SILENT-NONCODING | | | | |
| 503–504 | cg37026709 | 344 | GGCCGTGTGC TGGTACCAGG GATAC[C/G]CA GGAGCTCAGC AGATTTTGGCC TC | C | G | | | SILENT-NONCODING | | | | |
| 505–506 | cg38206730 | 335 | AGGCGTACAC GTGCAGGTGT GTTAC[G/A]TGT TCATTTTCGGC TCAAGGCGTAC | G | A | | | SILENT-NONCODING | | | | |
| 507–508 | cg38278821 | 212 | CGACGGTACT GGTTGCTCCTC GTAT[A/G]GAAA GCGGTGAATG CGAATGCAATG | A | G | | | SILENT-NONCODING | | | | |
| 509–510 | cg38403377 | 1024 | CGACGATCTCC CCGCGGTGTC GTCC[A/G]TAG GCGATACCGC GAGCATTGACG A | A | G | | | SILENT-NONCODING | | | | |
| 511–512 | cg38403377 | 1084 | TCCCCGAACC GTTGACGCCG AGAAG[A/G]AC ATTGTTGTTGT AAATCTTCTTG A | A | G | | | SILENT-NONCODING | | | | |
| 513–514 | cg38403377 | 1171 | TCGTTGCCGTGC CGTGAGCGAT CCGG[A/G]CGT TGCACCGGGT CATCCTGCGGT G | A | G | | | SILENT-NONCODING | | | | |
| 515–516 | cg38403377 | 934 | CCTCGGTGTGA GTGGCGTTCGT TAG[C/T]AGTGA TGCGATGGCG | C | T | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 517–518 | cg38446357 | 292 | GTCGTGCGAT TTTCCTCGCTG GGTATCTCCGC GAC[C/T]CCTC GGGCCCGTAG ACCGTCCTCGA | C | T | | | SILENT-NONCODING | | | | |
| 519–520 | cg38446677 | 312 | CACCTCCCATC GGAATGACGTA CGT[G/C]GTCA GAGACGATCC GACCGTCGTG C | G | C | | | SILENT-NONCODING | | | | |
| 521–522 | cg38446677 | 439 | TCGTCGCCGAA AGCAGAATGG CCAT[G/C]ACTT CGACGGCGGT GGCCGAGTCG A | G | C | | | SILENT-NONCODING | | | | |
| 523–524 | cg38446677 | 447 | GAAAGCAGAAT GGCCATGACTT CGA[C/T]GGCG GTGGCCGAGT CGAGGGCTCC G | C | T | | | SILENT-NONCODING | | | | |
| 525–526 | cg38869031 | 345 | ACATTGATTGT TCACATTTTTT TT[gap/T]TCTCTT CTCAATTTCCC TTGATTATA | gap | T | | | SILENT-NONCODING | | | | |
| 527–528 | cg38925867 | 196 | GCAACGGAGA TGACTCACAAG CTCG[T/C]TACG AGGCGGTAAG GCTCACCCGC G | T | C | | | SILENT-NONCODING | | | | |
| 529–530 | cg38925867 | 306 | AAGGCCAGTA GCACTCGTGCA GTT[G/C]GAC GATGAGACGTT GGCCTCGCGG C | G | C | | | SILENT-NONCODING | | | | |
| 531–532 | cg39373569 | 271 | AACATCTTGAA AATACACAAGT GGT[G/A]CAAA GATGTGTCACG | G | A | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a BLASTX analysis | Map location |
|---|---|---|---|---|---|---|---|---|---|---|---|---|
| 533–534 | cg39380084 | 120 | TTCTGGACCT CCTCGTTGCCT TATCTCCAGAT TCC[T/C]CAATT TCTGTGAAACG TAAACATTA | T | C | | | SILENT-NONCODING | | | | |
| 535–536 | cg39380084 | 130 | TTATCTCCAGA TTCCTCAATTT CTG[T/G]GAAA CGTAAACATTA TGGGAATAGT | T | G | | | SILENT-NONCODING | | | | |
| 537–538 | cg39402442 | 172 | TTCTTCTCTGC CATTCCTGGAG ATT[T/C]TGAAA AGAGTTGGTAA TGTGTTTCA | T | C | | | SILENT-NONCODING | | | | |
| 539–540 | cg39404391 | 113 | TTAGCCCAACA GCCTGGCACA AAGG[A/G]CAA CAATGAGGAGA GGAAAGGGGA G | A | G | | | SILENT-NONCODING | | | | |
| 541–542 | cg39404391 | 48 | GATTCCTACAC TATCCCCAAAA TGG[C/T]AGAG CTGGGCTCTCC CTGCAGTGGC | C | T | | | SILENT-NONCODING | | | | |
| 543–544 | cg39435025 | 186 | AAACTTTAACG TGTTATATCATT CA[A/T]GGCGT AACTTATACGC GCGGGTAC | A | T | | | SILENT-NONCODING | | | | |
| 545–546 | cg39485034 | 346 | CCGCCCAGGA ATTCGTTGAGTT TCCA[A/G]GTTG CTGAGCCATTG CCCGGATTCC | A | G | | | SILENT-NONCODING | | | | |
| 547–548 | cg39485034 | 400 | AGTACAGGCG ATCGCTGCCAC CGTT[A/G]GAC CATGGGAGCA GGTAGGACCC GC | A | G | | | SILENT-NONCODING | | | | |
| 549–550 | cg39485034 | 406 | GGCGATCGCT GCCACCGTTAG | T | G | | | SILENT-NONCODING | | | | |

TABLE 1-continued

| Seq ID | CuraGen sequence ID | Base pos. of SNP | Polymorphic sequence | Base before | Base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 551–552 | cg39485034 | 508 | ACCA[T/G]GGG AGCAGGTAGG ACCCGCCTTCC T GACCCGAGAT GGACTTCTTCG ACGA[A/G]GTT GCCACGGCTC CGTTAGCGAAA G | A | G | | | SILENT-NONCODING | | | | |
| 553–554 | cg39485034 | 519 | GACTTCTTCGA CGAAGTTGCCA CGG[C/T]TCCG TTAGCGAAAGC GATACGGCCG | C | T | | | SILENT-NONCODING | | | | |
| 555–556 | cg39515553 | 205 | CGCACTAAACC TTAAAATGCG AGA[G/gap]CGC ATGCACGGCG GACGTCGTGG AA | G | gap | | | SILENT-NONCODING | | | | |
| 557–558 | cg39515553 | 88 | TGTGTCCGGA GAAACCTCGTG CGGA[A/G]AAC AGCGCAAACC GCAAAAACCCC G | A | G | | | SILENT-NONCODING | | | | |
| 559–560 | cg39516001 | 168 | CGAAATGGAAA ATCGTCAATGA AGA[A/G]CCGA AATACGATGCT AAAGTTATTC | A | G | | | SILENT-NONCODING | | | | |
| 561–562 | cg39517070 | 164 | GCCGCCCAAA CAACGCTCACC GTTA[C/T]ACGC CGCAATGCGAG GCGTCTCAACC | C | T | | | SILENT-NONCODING | | | | |
| 563–564 | cg39517070 | 293 | TGTTTGCGCTC CACAGGGGAC CGCA[C/T]CGC CACTCCATCCA CAGCGCAAACA | C | T | | | SILENT-NONCODING | | | | |
| 565–566 | cg39517875 | 406 | GCTGACGGAT GAACGTCTCG GACAC[A/G]GC | A | G | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 567–568 | cg39517875 | 426 | GGACACCTCA GTGAATCTCCC TT GACACAGCGG ACACCTCAGTG AATC[T/G]CCCT TTGAGTAGATA CTGGACGAGA | T | G | | | SILENT-NONCODING | | | | |
| 569–570 | cg39523703 | 182 | GCACAGGAGA GCGGCGAGA CCGGG[C/T]GC AGCCCCTCCG ACATCATGCGC AC | C | T | | | SILENT-NONCODING | | | | |
| 571–572 | cg39524728 | 343 | ATATGCATATG TATGCACTCAT ACA[C/T]TCATA CATATGTGCCC CCTCAGAGA | C | T | | | SILENT-NONCODING | | | | |
| 573–574 | cg39527111 | 101 | GGCGACATGG GCGTCCCCAC GGCCC[C/T]GG AGGCCGGCAG CTGGCGCTGG GGA | C | T | | | SILENT-NONCODING | | | | |
| 575–576 | cg39530245 | 307 | GACATTCTCAT TCAGAGCGGA GAAA[T/A]TTCA GCAGATTTCAA GGAGCCGCCA | T | A | | | SILENT-NONCODING | | | | |
| 577–578 | cg39530249 | 729 | ACAAGCCTTCA CTTTCTTTCTT TT[C/gap]TTTTT TTTTTATCTAAC AACTGAAG | C | gap | | | SILENT-NONCODING | | | | |
| 579–580 | cg39535150 | 137 | CGGCTCTCCTG GATGTGCCCC CGCA[A/G]CAA TGCCAGGTAAG CCTTGGTCACG | A | G | | | SILENT-NONCODING | | | | |
| 581–582 | cg39536028 | 735 | CTGGCACACA GTATCCCAACC ATGG[G/A]TTTA GTGTCCACCAG ACTTAAAGGA | G | A | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 583–584 | cg39543172 | 580 | ATGTGTCTCCC ACACTGGCCG CTGC[A/T]CAAG CTGAGAAGCTG GGACGGCCCG | A | T | | | SILENT-NONCODING | | | | |
| 585–586 | cg39545648 | 532 | GCAATTTTACT CTACAGCTGAG ACA[C/T]TGCCA AAGAGTCCAGA ATTGTGAAG | C | T | | | SILENT-NONCODING | | | | |
| 587–588 | cg39547799 | 846 | AAAGTTGGAGA AACAGAAACCA AGG[C/T]GAGG TGGTCCTTGGT TAAGTCTGCA | C | T | | | SILENT-NONCODING | | | | |
| 589–590 | cg39550340 | 579 | TTTTTTTAAATA ACATCGTTGAT TA[A/G]AACAAT CCTATTCACTG CAGTCACA | A | G | | | SILENT-NONCODING | | | | |
| 591–592 | cg39568672 | 164 | GCTGGGTGGC TGACCAGCGCT TTGG[C/T]CAGT CAGGGGTTCG GTGGAATTGTTC | C | T | | | SILENT-NONCODING | | | | |
| 593–594 | cg39568672 | 248 | TACCACGGCAT CATGGTCGCTT TCG[C/T]GCTC GTTGGGTACG GATGGCTTGC G | C | T | | | SILENT-NONCODING | | | | |
| 595–596 | cg39568672 | 398 | TCGGGTATCAG GCCGTTGACAT GGC[A/G]CCCG CTTGTTATCGA TTCTCTCATC | A | G | | | SILENT-NONCODING | | | | |
| 597–598 | cg39570661 | 415 | ACGAGGGGAG CAAGCACGAG CCGGG[G/A]AG AGAGCTCTGC GCTCGCACAC GGG | G | A | | | SILENT-NONCODING | | | | |
| 599–600 | cg39575840 | 320 | CCCATGGTCCT CCCCATGTAAA GAG[C/T]TCTG | C | T | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 601–602 | cg39575840 | 361 | GCCAATCAACA AGGAGTGGAC AGGAGTGGAC AGCTCATACAA GGAC[C/G]ACC AAGTGGCCAAC AAACATAAAGC | C | G | | | SILENT-NONCODING | | | | |
| 603–604 | cg39602316 | 178 | TAGCAGGAGG AAGCTGATGAA TTGA[A/G]GTCC GATATAGGCAG TTTGTGCTCC | A | G | | | SILENT-NONCODING | | | | |
| 605–606 | cg39704218 | 348 | CAAACTCCTGG GCTCAAGCGAT CCT[C/T]CAACC CCGGCCTCCC AAAGTGCTGG | C | T | | | SILENT-NONCODING | | | | |
| 607–608 | cg41085637 | 479 | AAGACGGCCAT AGGAGGCGA TGGA[A/G]ACG GAGGCCAGCA CATCAGGGGA GG | A | G | | | SILENT-NONCODING | | | | |
| 609–610 | cg41591473 | 190 | AAATTGACATT TAAGTGGACCT GCC[G/A]TATTT GTATTTGCTAA ATCTGGCCA | G | A | | | SILENT-NONCODING | | | | |
| 611–612 | cg41592212 | 65 | ACGCGTGAGC CACCATGCCC GACGT[G/T]AA GACAGGAATTT ATACCCATGGA G | G | T | | | SILENT-NONCODING | | | | |
| 613–614 | cg41618657 | 555 | CAATTGGCTGT CCTATTTACAC TTA[C/T]GTGTC ATGTTAAAATA ATCATTTCT | C | T | | | SILENT-NONCODING | | | | |
| 615–616 | cg42267484 | 619 | GAACATCCCAT GCAAAAGACTT TTC[A/G]AAGG GAAGGGCCTG GTTTGAGAATG | A | G | | | SILENT-NONCODING | | | | |
| 617–618 | cg42312996 | 675 | TCACCTCCTTC | T | G | | | SILENT- | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 619–620 | cg42322469 | 385 | CCTTTATTCTA CCG[T/G]CCCA AGGGCCTGAG ATTGGGCGACT TCCTAAAACCA TTAGTATCTAC TAA[A/T]TTGAC GCTGAAATTTT GTATTTTTG | A | T | | | NONCODING SILENT-NONCODING | | | | |
| 621–622 | cg42327033 | 94 | GGCTTCTCAGG GGTCAGGTGC ATTT[G/T]GGCA GATGCGCTTGA GTGGGGGGGC | G | T | | | SILENT-NONCODING | | | | |
| 623–624 | cg42462046 | 142 | GGCCACAGCG CCCTGCCCCA GAGAA[C/T]GgG CGGGTGGGCT GGGTCCGGCT GCG | C | T | | | SILENT-NONCODING | | | | |
| 625–626 | cg42462046 | 98 | CCTGCCGCGC GCGGCGGGGC TCCTC[C/T]TCG CTGTGGGAAAA GTGGGGCCAC A | C | T | | | SILENT-NONCODING | | | | |
| 627–628 | cg42468895 | 296 | GCCTGGGCAA CAGAGCAGCA AGACT[G/gap]T CTTTACACTCG GGGTGAGTAG TCG | G | gap | | | SILENT-NONCODING | | | | |
| 629–630 | cg42518152 | 110 | GACACACATGC ACACGGTTTCA CCA[C/G]CACG GCTTCTCTCCA GCCTTCTCTT | C | G | | | SILENT-NONCODING | | | | |
| 631–632 | cg42534385 | 391 | GCGCCTACC ACAAGTCGGTG TGGC[G/gap]GgG GGGTGGAGGC CAAGCTGCACC TG | G | gap | | | SILENT-NONCODING | | | | |
| 633–634 | cg42534385 | 396 | TACCACAAGTC GGTGTGGCGG | gap | G | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of Name of protein identified following a BLASTX analysis of the CuraGen sequence | BLASTX analysis | Similarity (pValue) following a location | Map |
|---|---|---|---|---|---|---|---|---|---|---|---|---|
| 635–636 | cg42560726 | 616 | GGGG[gap/G]TG GAGGCCAAGC TGCACCTGCG CCG CGCCTGTAATC TCAGCACTCTG GGA[A/G]GTCA AGGCAGGTGG ATCACTTGAGC | A | G | | | SILENT-NONCODING | | | | |
| 637–638 | cg42656733 | 325 | GGGACCACGA TGGACTGAGC CAGCT[T/C]TGC CCGCCCGCCC CCGCGCCCAG GG | T | C | | | SILENT-NONCODING | | | | |
| 639–640 | cg42658258 | 510 | GGCCTGCAGA CTCGGGCCC AGGGC[C/gap]A CCGGCCTCTC CTACCTGCTCC TGC | C | gap | | | SILENT-NONCODING | | | | |
| 641–642 | cg42673467 | 656 | ATAGACCAACA ATCATGTATCC TGC[C/T]ACTTG GGATGCCAGC ACCCATGCCA | C | T | | | SILENT-NONCODING | | | | |
| 643–644 | cg42691712 | 697 | CCGAGCAGTG GCCGCGTGCA GGAGT[C/A]CA GAGTGGAGCC GTGACTCACAA TT | C | A | | | SILENT-NONCODING | | | | |
| 645–646 | cg42705180 | 89 | CTTTGGCAAAT TGGGGACTGA AGAC[G/T]GGA AGGGTGGAGA GTAGGCGGAA CC | G | T | | | SILENT-NONCODING | | | | |
| 647–648 | cg42705180 | 96 | AAATTGGGGAC TGAAGACGGG AAGG[G/A]TGG AGAGTAGGCG GAACCAGGTG GT | G | A | | | SILENT-NONCODING | | | | |
| 649–650 | cg42718789 | 107 | GAATTCAACAA | A | G | | | SILENT- | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 651–652 | cg42719781 | 228 | CACTATAGAGT CAA[A/G]AGGA AACGAGTCGA GTGAAACCAGT GATTCTGATTT TAGTGATGATG AAC[G/A]CTGT GGAGAATCCA GCAAAAGGAAA | G | A | | | NONCODING SILENT-NONCODING | | | | |
| 653–654 | cg42848362 | 34 | CATGCAGGCG CGCCTGTAGTC CCAG[C/T]TACT CGGGAGGCTG ACGCAGGAGA A | C | T | | | SILENT-NONCODING | | | | |
| 655–656 | cg42848627 | 156 | TCCTCCATCAC CAGGCTGTCTA ACG[A/G]GGCT GAAGAAGTACC ATCCATGAGT | A | G | | | SILENT-NONCODING | | | | |
| 657–658 | cg42895723 | 781 | CAGGGTGCCA GGCACTTCTTT AATG[T/G]GTTC TTTCTTTATGTG ATTATTTGA | T | G | | | SILENT-NONCODING | | | | |
| 659–660 | cg42910590 | 365 | GCCCGGGACG AGGGAGAATCT GCAG[T/C]AGC TGAGGACCCC ACATGGGGTG AG | T | C | | | SILENT-NONCODING | | | | |
| 661–662 | cg42913480 | 419 | ATGTGGGAAA AGCAAGAGAG ATCA[A/G]ATTG TTACTGTGTCT GTGTAGAAAG | A | G | | | SILENT-NONCODING | | | | |
| 663–664 | cg42919036 | 1141 | GAGGCAGATG ATTCCAAGAG AACT[C/T]ACCA AATCAAGACAA ATGTCCTAGA | C | T | | | SILENT-NONCODING | | | | |
| 665–666 | cg42919304 | 313 | GAGGAAGGCA AACAGAAAGGC AAGG[G/A]CAG CAAACCTTTAA | G | A | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 667–668 | cg42922781 | 404 | TGCCTACCTCC GAGGCGGGTT AGTGCCCATG GATCC[G/A]GT GTCTGGGAAG GGGCCCACAG AAG | G | A | | | SILENT-NONCODING | | | | 9 |
| 669–670 | cg42924993 | 364 | TTTTAGGCCAG GTGCAGTGGC TCAC[A/G]CCCT TAATCCCAGCA CTTTGGGAGG | A | G | | | SILENT-NONCODING | | | | |
| 671–672 | cg42924993 | 450 | AGACCAGCCT GGCCAACATG GTGAA[A/G]CC CCGTCTCTACT AAAATACAAA A | A | G | | | SILENT-NONCODING | | | | |
| 673–674 | cg42925336 | 402 | TCATGAGGAAG GCCAGGACAA GTG[G/T]GCA GAGCGGCTTA CCCCCATGGC AC | G | T | | | SILENT-NONCODING | | | | |
| 675–676 | cg42943021 | 16 | GCGCGCCAGG ACGCC[C/T]GG CTGTTTTGTATT TTTAGTAGAGA | C | T | | | SILENT-NONCODING | | | | |
| 677–678 | cg42943021 | 23 | GCGCGCCAGG ACGCCCGGCT GT[T/C]TTGTAT TTTTAGTAGAG ACAGGGTT | T | C | | | SILENT-NONCODING | | | | |
| 679–680 | cg42943021 | 27 | CGCGCCAGGA CGCCGGCTG TTTTG[T/C]ATT TTTAGTAGAGA CAGGGTTTTGA | T | C | | | SILENT-NONCODING | | | | |
| 681–682 | cg42943021 | 68 | AGGGTTTTGAG TGATCTGTCCA CCT[T/C]AGCCT CCAAAGTGCT GGGATTACA | T | C | | | SILENT-NONCODING | | | | |
| 683–684 | cg42943021 | 90 | CCTTAGCCTCC CAAAGTGCTGG | T | C | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 685–686 | cg43008177 | 233 | GA[T/C]ACAG GCATGAGCCA CTGTGCCCCG C | C | A | | | SILENT-NONCODING | | | | |
| 687–688 | cg43008177 | 280 | ACATCAAATTA GCAATTACCAT AGA[C/A]ATGTA TTTCATTGAATA AATAGCTT | gap | G | | | SILENT-NONCODING | | | | |
| 689–690 | cg43008177 | 313 | CTTTTGTTTGTT TGTTTGTTTGTT T[gap/G]CAGGG AAATTTAGAAC AATTATTAG | A | T | | | SILENT-NONCODING | | | | |
| 691–692 | cg43040173 | 591 | ATTTAGAACAA TTATTAGATGTT AT[A/T]GTGCCT CTTCTCGTTGTT GATACGTG | C | gap | | | SILENT-NONCODING | | | | |
| 693–694 | cg43054295 | 281 | GGGAAACCCC AGGGGAGGCG GAGGC[C/gap]A GCGGGGATTT CTGAAGCCAAG TGG | C | G | | | SILENT-NONCODING | | | | X |
| 695–696 | cg43054295 | 317 | GAGGCTGGCG GGCTAGGGCT GAGTG[C/G]AG CGCCTGCCTAG AGACCTTCGG GA | C | T | | | SILENT-NONCODING | | | | X |
| 697–698 | cg43054295 | 355 | TAGAGACCTTC GGGAGAACTTC TGC[C/T]GGAA CCCGACGGC TCAGAGGCGC C | A | C | | | SILENT-NONCODING | | | | X |
| 699–700 | cg43060167 | 673 | GCTCAGAGGC GCCCTGGTGC TTCAC[A/C]CTG CGGCCCGGCA CGCGCGTGGG CT | C | T | | | SILENT-NONCODING | | | | 4 |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 701–702 | cg43076634 | 27 | AACC[C/T]CTTC CAGATAAAGAC AGTGGGCACT GCGCGCCTAC | T | G | | | SILENT-NONCODING | | | | |
| 703–704 | cg43089031 | 202 | CACGTCAAGCT AATT[T/G]TTG TATTTTAGTAG AGGTGGGGTT AAATGGGCCA GGCGCGGTGA | A | G | | | SILENT-NONCODING | | | | |
| 705–706 | cg43089031 | 244 | CTCAC[A/G]CCT ATAATCCCAGC ACTTTGGGAGG TTTGGGAGGC CGAGGAGGGT GGATC[A/G]CC | A | G | | | SILENT-NONCODING | | | | |
| 707–708 | cg43149120 | 317 | TGAGGTCAGG AATTCCAGACC AG CCAAGAAGAC GCTGGAGGGA GGCTG[T/C]TA GGAGGGACTC TGAGCTTCACA CC | T | C | | | SILENT-NONCODING | | | | 17 |
| 709–710 | cg43256880 | 128 | GGGAATCTTCT CTTTGACGTAT GGG[A/G]AGCC TCAGAAAGACA TTTTCCTAAT | A | G | | | SILENT-NONCODING | | | | |
| 711–712 | cg43256880 | 191 | GAATGGCCCTA TGATGTTTCCT TCG[A/G]AACT GGTACTGCTCA GCCCTGATCA | A | G | | | SILENT-NONCODING | | | | |
| 713–714 | cg43261262 | 805 | GTGTTTTGGATT TGATCATGGAT GTA[G/A]CATAC ACCAAAATCCA CCGAGACCT | G | A | | | SILENT-NONCODING | | | | 16 |
| 715–716 | cg43276309 | 1051 | TTGGCTTGGGG GGTCCACAGT GAGG[C/T]AGA TGCTGGGCGT GAAGAATCTGC | C | T | | | SILENT-NONCODING | | | | 19 (19q13.3) |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 717–718 | cg43276309 | 1149 | GGCCTGGAGG GGCCACCAAG ATGCA[G/T]GA GCTGGGCCTG GAGAGGCTGC AAA T | G | T | | | SILENT-NONCODING | | | | 19 (19q13.3) |
| 719–720 | cg43276380 | 686 | GTCCACTGTGA GGCAGAGGCT GGGC[G/C]TGA AGAATCTGCTG TGAGGCAGAT G | G | C | | | SILENT-NONCODING | | | | |
| 721–722 | cg43304080 | 347 | GCCGGGCAGA GTGGAGCAGC TTGGG[G/A]CC GTGCCAGGG CGGTGGCTGT GAG | G | A | | | SILENT-NONCODING | | | | |
| 723–724 | cg43323676 | 303 | GGTGTGGTGT GGATTGTAGCT TCCC[G/A]AAAC TCATGGCGCCT CCCCTCGAC | G | A | | | SILENT-NONCODING | | | | |
| 725–726 | cg43326623 | 188 | GGATAACCAGA ATTATCACAGC ACC[C/T]TCTCA TTCCCAGCGC GTCCTTCTGA | C | T | | | SILENT-NONCODING | | | | |
| 727–728 | cg43328092 | 168 | TTGCTGTGTAA GAATAGGTCCC TCA[A/G]CATGA AGATGTGTCTG CGTCTGAGC | A | G | | | SILENT-NONCODING | | | | 8 |
| 729–730 | cg43328259 | 499 | AGCCTTCAGG GAGCGTGGAG ACAGG[C/T]TTT GAAGACAAGAT TCCAAAAGGA | C | T | | | SILENT-NONCODING | | | | |
| 731–732 | cg43328259 | 771 | ACGGCCATGG AGACTGCAATT CCAT[T/C]CAGA TCACGTTTCTT CAATCTGAAG | T | C | | | SILENT-NONCODING | | | | |
| 733–734 | cg43336005 | 591 | GATGTTTGGCT | T | G | | | SILENT- | | | | 22 |

TABLE 1-continued

| Seq ID | CuraGen sequence ID | Base pos. of SNP | Polymorphic sequence | Base before | Base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 735–736 | cg43916688 | 3263 | GCACGCGAGC CCAC[T/G]CGG GACAGACCCAA GAACACGAATT GCGGCGAGAG CGGCTCCTCTG CGCA[G/gap]CC GGCGCGGCT CCGCTTCCCCT TC | G | gap | | | NONCODING SILENT-NONCODING | | | | 11 |
| 737–738 | cg43917746 | 251 | TGGATAGAAGT GCTTCACTAAT TGC[T/C]TTATT TAAGCATACAA GAAAAAAG | T | C | | | SILENT-NONCODING | | | | 20 |
| 739–740 | cg43917746 | 471 | CAAGCATGGC CCAGCCAGCA CCACC[A/G]CC CCAAAAAGAA CAAAACAAGAG A | A | G | | | SILENT-NONCODING | | | | 20 |
| 741–742 | cg43918370 | 648 | TCACCAGGAAA GCCTGCCTCCT CCG[A/G]GGAC CTGCCCGCCT CCGGGAGCAG C | A | G | | | SILENT-NONCODING | | | | |
| 743–744 | cg43919788 | 1419 | AGGGACATAGA ACCAAGCCCCA GGG[C/G]TGCC CAGCTACACGA CCGCCGCTGG | C | G | | | SILENT-NONCODING | | | | |
| 745–746 | cg43919798 | 780 | ACTCACCTTAT TCTTCATTTCC CCT[C/G]GTGA ATCCTCCAGGC CTTTCTCTAC | C | G | | | SILENT-NONCODING | | | | |
| 747–748 | cg43921083 | 318 | CAGGCCGGTG ACCCCCATG GAGCC[T/C]CA CATGGCGAAG AGGATGAGGA AGG | T | C | | | SILENT-NONCODING | | | | 17 |
| 749–750 | cg43921103 | 471 | CAGGGAGACG CCAGCATTAAA | gap | A | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 751–752 | cg43921107 | 386 | AAAA[gap/A]GA GAGATGTGTTT ATTCCATGATC A GGGTGCTGGC CTTCCTGGCCT CGGC[C/T]TTCT TCTTGGTTGGTC GACGCGTATT | C | T | | | SILENT-NONCODING | | | | |
| 753–754 | cg43921619 | 466 | AGAGCTGGAG GAGGTATTTGT GAAG[G/T]AGC AGGGAGAAGA GGAGCTGCTG AG | G | T | | | SILENT-NONCODING | | | | 17 |
| 755–756 | cg43925523 | 173 | GGATTCTTGGC TGAAGAATTCC TCT[G/A]GAAAT ATTTCCAGGC CAAAGGTGG | G | A | | | SILENT-NONCODING | | | | |
| 757–758 | cg43926586 | 75 | ACACCATGCTG GCCGTGGTGC GAAA[G/gap]CC TCCCGAGTCCA TACAGATACCA C | G | gap | | | SILENT-NONCODING | | | | 19 |
| 759–760 | cg43926872 | 697 | TTCTGCGGCC GCATCCTGAGC ATGG[T/G]GAA CACAGATGATG TCAACGCCATC | T | G | | | SILENT-NONCODING | | | | 2 |
| 761–762 | cg43927587 | 4712 | GCGGGATGTTT CTTGGGGCA GCTC[G/A]GGT GGAGACACGA CACTTTCTACT | G | A | | | SILENT-NONCODING | | | | |
| 763–764 | cg43927587 | 4793 | CTTCCTCCAGC GGCACAGGGT ATTG[C/T]AGAT GGGTCACCAG CCCATGTTTT | C | T | | | SILENT-NONCODING | | | | 2 |
| 765–766 | cg43927733 | 274 | CTACACAGGAA GCTGGAAAGAT GAC[A/G]AGAT | A | G | | | SILENT-NONCODING | | | | 2 |

TABLE 1-continued

| Seq ID | CuraGen sequence ID | Base pos. of SNP | Polymorphic sequence | Base before | Base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 767–768 | cg43927893 | 1071 | GAATGGTTTTG GAAGACTTGA AGCATTGGTGC CCTCATGGCTC ATG[T/C]GGAC GCAGTAATCCG CCACTGTGCA | T | C | | | SILENT-NONCODING | | | | |
| 769–770 | cg43927893 | 1329 | GCCAACATCGA GCCACTCTTTG ACC[G/A]GTTG CTCATTTCTG GTCTGACCGG | G | A | | | SILENT-NONCODING | | | | |
| 771–772 | cg43929036 | 299 | TGGGCAGCCG ACCCCTTGCAG CGCT[G/gap]GC CAGCGGCCGC CACCACCACAC CG | G | gap | | | SILENT-NONCODING | | | | |
| 773–774 | cg43929036 | 300 | GGGCAGCCGA CCCCTTGCAGC GCTG[G/gap]CC AGCGGCCGCC ACCACCACACC GC | G | gap | | | SILENT-NONCODING | | | | |
| 775–776 | cg43929139 | 2789 | TAATCTGTTCA ACCGAGGTCT TTG[A/G]AAACG AAGATCAAAAC AATAATGAA | A | G | | | SILENT-NONCODING | | | | |
| 777–778 | cg43929139 | 2828 | AACAATAATGA ACCAGAGAGC GAAT[C/T]TTGG GATGATTTCTA TCATTGCACA | C | T | | | SILENT-NONCODING | | | | |
| 779–780 | cg43929139 | 2834 | AATGAACCAGA GAGCGAATCTT GGG[A/G]TGAT TTCTATCATTG CACATACAAA | A | G | | | SILENT-NONCODING | | | | |
| 781–782 | cg43929139 | 2861 | GATTTCTATCA TTGCACATACA AAT[A/G]ATGG GAATTTTAGTA TGTTTTATCA | A | G | | | SILENT-NONCODING | | | | |
| 783–784 | cg43929652 | 984 | CACTTGTTAGG | G | A | | | SILENT- | | | 17 | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| | | | CTCTTGTCAGC ATT[G/A]ATAAC TGGCATGTTTT ATTGCAGCC | | | | | NONCODING | | | | |
| 785–786 | cg43929990 | 1931 | GTGTTAACTTG AAGAGATTCAA CTT[C/T]TTCTT TGACTGGTACT TCCGCCCTA | C | T | | | SILENT-NONCODING | | | | 10 |
| 787–788 | cg43931352 | 111 | GCGTCGTTCCT CCGGTCCATCT CGC[T/C]CATG CTCAGGGCGG TGGCAAAGGG G | T | C | | | SILENT-NONCODING | | | | 6 |
| 789–790 | cg43931759 | 2018 | AGCTGGGATGT ACCTGGAGAG ATAG[G/C]GGG TAGTTCTCCCT ACTGCCCAGG C | G | C | | | SILENT-NONCODING | | | | 7 |
| 791–792 | cg43931795 | 1456 | AGAATGGCAG GCGGACCGTG GCGAA[G/gap]G CTCTGCCCTGG TTGAACATTTC TG | G | gap | | | SILENT-NONCODING | | | | |
| 793–794 | cg43933469 | 689 | TGTGCCAGGT GCCCGTCTGA GCTGG[C/A]TC CATCATGACGC GTCACTTTGTC C | C | A | | | SILENT-NONCODING | | | | |
| 795–796 | cg43934707 | 651 | CGGTGGGACC AGCGCCATCAC CTCC[G/A]TAC GGATGTTCTCC CTCCGGAAGC C | G | A | | | SILENT-NONCODING | | | | |
| 797–798 | cg43934839 | 1383 | CCAACCATGCA TTAAGTTTAAC CAA[A/G]AGCT GCAATATTCCA GATTCTTAAA | A | G | | NONCODING | SILENT- | | | | 13 |

TABLE 1-continued

| Seq ID | CuraGen sequence ID | Base pos. of SNP | Polymorphic sequence | Base before | Base after | Amino acid before | Amino acid after | Type of change | Protein classification of Name of protein identified following a BLASTX analysis of the CuraGen sequence | BLASTX analysis | Similarity (pValue) following a location | Map |
|---|---|---|---|---|---|---|---|---|---|---|---|---|
| 799–800 | cg43934839 | 1547 | GGTGCCTGTTT ACTTCTCGTCT GCG[C/T]GGGC TCAGGTTTCAA AGAGCTTGCT | C | T | | | SILENT-NONCODING | | | | 13 |
| 801–802 | cg43934938 | 4214 | TGAGGAAACCT AGGAAATCTCG GTG[C/T]ACTAG GAAGTGAATCC CGCAGGACA | C | T | | | SILENT-NONCODING | | | | 16 |
| 803–804 | cg43934938 | 4231 | TCTCGGTTGCAC TAGGAAGTGAA TCC[C/T]GCAG GACAGCTGCA CTCAGGGATAC | C | T | | | SILENT-NONCODING | | | | 16 |
| 805–806 | cg43934938 | 4351 | GATTGTCTTTC TGCCACAGAAC AGC[A/T]GCAG ACGTGTCGGG AGGTTAGCTGC | A | T | | | SILENT-NONCODING | | | | 16 |
| 807–808 | cg43934938 | 4391 | AGGTTAGCTGC GGAAAGAAATC GGG[A/C]TGCC GCGGAGCACA GAGTGATTTGG | A | C | | | SILENT-NONCODING | | | | 16 |
| 809–810 | cg43934938 | 4395 | TAGCTGCGGAA AGAAATCGGGA TGC[C/T]GCGG AGCACAGAGT GATTTGGAACT | C | T | | | SILENT-NONCODING | | | | 16 |
| 811–812 | cg43935748 | 1437 | ATGCTATGGGT ATCTGTTTCAG AAG[C/T]TCTGT TGGTATCTTGT GGTGTCTGC | C | T | | | SILENT-NONCODING | | | | 14 |
| 813–814 | cg43935826 | 266 | TCATTACGGTC ACAATGACGAT GTC[A/G]GAAA CCATGCAATGA AACCAATAAA | A | G | | | SILENT-NONCODING | | | | |
| 815–816 | cg43936051 | 705 | TCAGAAAAAAA GCTATCCAGCT TTT[C/T]GTGGA ATCTGGTGAAG TTTACACTT | C | T | | | SILENT-NONCODING | | | | 4 |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 817–818 | cg43939976 | 1317 | CCGTCGGTCCT GGCGTAGCGC CTCC[C/gap]GT GTCCGGGGTA GATCTTGTACC CG | C | gap | | | SILENT-NONCODING | | | | 6 |
| 819–820 | cg43941070 | 1254 | ATGTTCCCCGG CCTGCGACCAA GAC[G/A]CTTTT TCCTGACTACT TCTTCAACT | G | A | | | SILENT-NONCODING | | | | 17 |
| 821–822 | cg43941070 | 1278 | CGCTTTTTCCT GACTACTTCTT CM[C/T]TCTGA CATAGGTTTTG CTGATATAA | C | T | | | SILENT-NONCODING | | | | 17 |
| 823–824 | cg43941070 | 1284 | TTCCTGACTAC TTCTTCAACTC TGA[C/T]ATAGG TTTTGCTGATA TAAACGCAA | C | T | | | SILENT-NONCODING | | | | 17 |
| 825–826 | cg43941070 | 1305 | CTGACATAGGT TTTGCTGATAT AAA[C/T]GCAAA CCCGGCTCTAT ACCTACCAA | C | T | | | SILENT-NONCODING | | | | 17 |
| 827–828 | cg43942215 | 5435 | AGCCAATATAG GGCCTCGTCTC ACT[C/T]AGGTG TCAGTGCTGCA GTATGGAAG | C | T | | | SILENT-NONCODING | | | | 12 |
| 829–830 | cg43942920 | 1632 | TGCGTGGTGA CGGGCAGTGA GGACA[T/G]GT GCGTGCACTTC TTTTGATGTGGA G | T | G | | | SILENT-NONCODING | | | | X |
| 831–832 | cg43942990 | 826 | GGCTGTAGAAT ACCTTCTCCTT GAC[G/A]GGGT ACAGCAGCTCC ACATCCCTCT | G | A | | | SILENT-NONCODING | | | | 1 (1p11) |
| 833–834 | cg43943163 | 881 | CTGAGCTATAA ACTTGTCADAG ATT[T/C]GCTGT | T | C | | | SILENT-NONCODING | | | | 1 |

TABLE 1-continued

| Seq ID | CuraGen sequence ID | Base pos. of SNP | Polymorphic sequence | Base before | base after | Amino acid before | Amino acid after | Type of change | Protein classification of Name of protein identified following a BLASTX analysis of the CuraGen sequence / BLASTX analysis | Similarity (pValue) following a location | Map |
|---|---|---|---|---|---|---|---|---|---|---|---|
| 835–836 | cg43944408 | 1076 | GTCATCGCAG GCTGCAACTG AGGAGGCAAT GAGATGATGG GGTGA[gap/G]G GAAACATGAAA GTAACACTTGA TT | gap | G | | | SILENT-NONCODING | | | 17 |
| 837–838 | cg43944446 | 906 | ACTCTGATCGG TTATTATCCCC TCA[T/gap]TTTT TGTAGGAAATA AGTTTGCTTG | T | gap | | | SILENT-NONCODING | | | 16 |
| 839–840 | cg43946473 | 880 | CACAGAAAAGA CAACAGATGTG TTT[C/T]TAAGG CACGATTTACA TACTAAATT | C | T | | | SILENT-NONCODING | | | 11 |
| 841–842 | cg43946992 | 136 | ACATCTGGGTT GACCAGGAGC CACA[A/G]AAGT TCCCATCATGA GAAAGGGGGC | A | G | | | SILENT-NONCODING | | | 22 |
| 843–844 | cg43947759 | 876 | TCAAACTTCTGT AAGATGGGGG GGGG[gap/G]A CAAAAGAGAA GTAAAGTTAAG AA | gap | G | | | SILENT-NONCODING | | | |
| 845–846 | cg43948617 | 1024 | AGAGGTTATCA AGGACATTTAA GGA[A/G]TCCT GATCCTCAGAA CTTCTCTGGG | A | G | | | SILENT-NONCODING | | | 8 |
| 847–848 | cg43949585 | 1172 | GTAATGTTAAA ACTAAATACAG ATG[A/G]TAATA ATTGCTATTTC ACAGTGATG | A | G | | | SILENT-NONCODING | | | |
| 849–850 | cg43949806 | 460 | TTACCAACCCT GGGGCTTTATA CTC[C/T]CTCTC CACCAATCCCT GATGACCCC | C | T | | | SILENT-NONCODING | | | 16 (16p13.1) |
| 851–852 | cg43950348 | 1308 | GGCATTGCAG | A | C | | | SILENT- | | | 9 |

TABLE 1-continued

| Seq ID | CuraGen sequence ID | Base pos. of SNP | Polymorphic sequence | Base before | Base after | Amino acid before | Amino acid after | Type of change | Protein classification of Name of protein identified following a BLASTX analysis of the CuraGen sequence | BLASTX analysis | Similarity (pValue) following a location | Map |
|---|---|---|---|---|---|---|---|---|---|---|---|---|
| 853–854 | cg43950620 | | CGGCTCGGGG TCCAA[A/C]GC CTCACTACCAG TCTGGGTCCG GC | | | | | NONCODING | | | | |
| 855–856 | cg43951104 | 262 | AGCAAGGAATG TTCTTATTCTTT GT[A/G]GGAGC TCCTTCTTTAC ACTGTCAGG | A | G | | | SILENT-NONCODING | | | | 8 |
| 857–858 | cg43951505 | 679 | TAGTGAAAACC AAGTGACAAAC ACA[C/T]TCCTC GACCCAAGTT CTTCCACAT | C | T | | | SILENT-NONCODING | | | | 17 |
| 859–860 | cg43952456 | 603 | AAAGGTGGAAA ATGAGGTTGAT CGC[A/C]GCAT TCAGAAAGTGT ATAAGACCTA | A | C | | | SILENT-NONCODING | | | | |
| 861–862 | cg43952456 | 394 | AATGCTAAACT GCTTTCATGCT AAT[T/C]TTCTG ACTGTTTACTT ACCGGGTAA | T | C | | | SILENT-NONCODING | | | | |
| 863–864 | cg43952456 | 401 | AACTGCTTTCA TGCTAATTTTCT GA[C/A]TGTTTA CTTACCGGGTA AGAGCGAT | C | A | | | SILENT-NONCODING | | | | |
| 865–866 | cg43953844 | 416 | AATTTTCTGAC TGTTTACTTAC CGG[G/C]TAAG AGCGATGGGA CTGTTTTCATT | G | C | | | SILENT-NONCODING | | | | |
| 867–868 | cg43955665 | 1867 | CTCAACCTGCC TTAGCTGCACT CTC[T/C]TACCT ACAGCTGGACA GTACCTGTC | T | C | | | SILENT-NONCODING | | | | 7 |
| | cg43955665 | 184 | CTGCCAGCTGA CAGGATCTTTT GCT[G/A]GGCC CCCTTCTCTGT GCTGAGTGGA | G | A | | | SILENT-NONCODING | | | | 16 (16q22) |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 869–870 | cg43955829 | 593 | ATAAGGCCATT CAGCGAGGGA CCAT[C/T]AAGT GCAACTTTGCG GGGGTTGCCT | C | T | | | SILENT-NONCODING | | | | |
| 871–872 | cg43955863 | 290 | AGGACACCAA GGTACCCAATG CCTG[G/C]TTAT TCACCATCAAC AAAGAAGACC | T | C | | | SILENT-NONCODING | | | | 7 |
| 873–874 | cg43955871 | 1011 | AGCGCTCCTCC AGCAGGGACA GCTC[A/G]CTG ATGAGGTCGGT GATGGCGTTG G | A | G | | | SILENT-NONCODING | | | | 7 |
| 875–876 | cg43957194 | 591 | CCATTTTTAGC ATCAGAAACAC AAG[G/A]AAATA AAATTCGTGGT TAGATTGAT | G | A | | | SILENT-NONCODING | | | | — |
| 877–878 | c943957205 | 782 | ATACCTGAGGT TTCATGTCTTTA GT[T/C]GCCTTA TCATAATCCCA AATATACA | T | C | | | SILENT-NONCODING | 13 | j | | 5 |
| 879–880 | cg43958108 | 777 | CAGCAAACCTG AATGGCACAAT GGA[A/G]CACA GACTTAAAAGA TGCTTCAGTG | A | G | | | SILENT-NONCODING | | | | 22 |
| 881–882 | cg43959150 | 709 | ACTTCCACGCG GTGAACGTGG CGCA[C/gap]CC GTTCGCTTCAG CAGTTTCCTAG | C | gap | | | SILENT-NONCODING | | | | 17 |
| 883–884 | cg43959363 | 614 | CTTCATTTCTTT GGTTTCTTGGG TAT[G/A]TGGGC GCCGGAACAG CAAGATGTGA | G | A | | | SILENT-NONCODING | | | | 17 |
| 885–886 | cg43960242 | 16 | ACTGCAACGC GGAGG[A/G]GC AGGATGGAGAT | A | G | | | SILENT-NONCODING | | | | 19 |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 887–888 | cg43960953 | 2143 | CCCTGTGCCTG T AACAGTGGGC ATGTCTTCTCG CGGT[C/A]GAT CGGTTTCTCTG GCTCCTTCTTA | C | A | | | SILENT-NONCODING | | | | |
| 889–890 | cg43962392 | 910 | AAAGAAGGTAG AGGAACTTGG GAGA[C/T]TGA GGGAAAGATA GGAGAGAGGA AG | C | T | | | SILENT-NONCODING | | | | 1 |
| 891–892 | cg43964611 | 319 | GCTGGGCTTC CCCGAGCTGG AGAGC[G/A]GG GAGGACCAGC CCTTCTCCAGG CT | G | A | | | SILENT-NONCODING | | | | 4 |
| 893–894 | cg43965993 | 2007 | GTCGTTTTCTC AAAAAAATATC GTA[T/C]AAGTG ACTCATCCTGT CTGCTAACT | T | C | | | SILENT-NONCODING | | | | 7 |
| 895–896 | cg43966536 | 659 | CCCAGTATGTA CCACCCCGTTT CTC[G/A]TAAAT GAAGGCAGCA GCTCCAGCCA | G | A | | | SILENT-NONCODING | | | | 9 |
| 897–898 | cg43967276 | 314 | CACGTGCGTG GGGTGTTGGC ATTCT[T/C]GTT ATTTAACACGG GAAGGAGGTG A | T | C | | | SILENT-NONCODING | | | | 12 |
| 899–900 | cg43967511 | 276 | TAGTCCTGTTG ACCTGGAAATG GTG[G/C]CAGG TGAAGTCTCTC CACAGCATGC | G | C | | | SILENT-NONCODING | | | | 17 (17q22) |
| 901–902 | cg43968814 | 3546 | GCCAGAGCTTC CGCGCCCTCG CCTG[C/T]CCA GGTGTCCTGCT CGCCTCCATCT | C | T | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 903–904 | cg43969044 | 734 | CCTCTGATGTT CAGTGAAGAG GACC[A/G]GAA AAGTCTGCTAG AGCAGTACCAT | A | G | | | SILENT-NONCODING | | | | 5 |
| 905–906 | cg43970408 | 949 | CTCTTTGGCTT GTTTTGGCGCT GGC[G/gap]CTG GCAGAGGCTG AGACACGGCG AG | G | gap | | | SILENT-NONCODING | | | | 17 |
| 907–908 | cg43970722 | 769 | CCACCATCTCC GTTGTTTCTGG AAG[C/T]ACCCT CCAGGCAGGC CAGCCAGCAT | C | T | | | SILENT-NONCODING | | | | 20 |
| 909–910 | cg43971702 | 705 | CTCAGCTCCTC CAAATGGTTGT CCA[C/T]CCCA GACGACTGGG GGGTTGGTGG A | C | T | | | SILENT-NONCODING | | | | 15 |
| 911–912 | cg43971764 | 4293 | CCTCAGCCTCC CAAAGTGCTGG GAT[T/C]ACAG GCATGAGCCA CCACGCCGG C | T | C | | | SILENT-NONCODING | | | | 8 |
| 913–914 | cg43972482 | 412 | TTAGTAGAGAC GGGGTTTCACC ATG[T/C]TGGTC AGGCTGGTCTC GAACTCCTG | T NON-CODING | C | | | SILENT- | | | | 19 (19q13.4) |
| 915–916 | cg43973408 | 205 | ACCGAGGAGC AGGAATATGAG GAGG[A/G]GCA GCCGGAAGAG GAGGCTGCGG AG | A | G | | | SILENT-NONCODING | | | | |
| 917–918 | cg43974489 | 666 | GGCTAGCCCA CCTGCCATGGT TGCC[T/C]TTCT GCTTGGGGAT GCCCTGTCT | T | C | | | SILENT-NONCODING | | | | 1 |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 919–920 | cg43974987 | 1386 | CATCCTCAGAG TCTGAGCGGC ACCG[C/gap]AG ACCTTCTTTTC AAGTTCACTAA G | C | gap | | | SILENT-NONCODING | | | | 22 |
| 921–922 | cg43977577 | 590 | CGTAGTGTAAA GAACGTAAATT GAA[G/gap]GCC CCGGGCCAATT CTGGGAAGA | G | gap | | | SILENT-NONCODING | | | | |
| 923–924 | cg43977577 | 591 | GTAGTGTAAAG AACGTAAATTG AAG[G/gap]CCC CGGGCCAATTC TGGGAAGAGG A | G | gap | | | SILENT-NONCODING | | | | |
| 925–926 | cg43977954 | 2556 | TGTGAACGGC CCGGAGAGAG CTGGG[T/A]GG TGTATGGGGTG ACCTCCTGGG GG | T | A | | | SILENT-NONCODING | | | | 2 |
| 927–928 | cg43979039 | 674 | CGCCCCTCACA GTGAAGAATCA GGA[C/G]AGCC ACTCTCTGGTT TTCTCACAAC | C | G | | | SILENT-NONCODING | | | | 2 |
| 929–930 | cg43979039 | 769 | GTCCTGGTCCC ACACAGAGAGA GGA[A/G]GCGC CACAACCCACT CTGCCAACCT | A | G | | | SILENT-NONCODING | | | | 16 |
| 931–932 | cg43980463 | 970 | AGAAGCTGGCT GGTAGGACCC GCAG[G/gap]GA CCAGCTGACCA GGCTTGTGCTC | G | gap | | | SILENT-NONCODING | | | | 5 (5q13.3) |
| 933–934 | cg43980508 | 349 | TTCTTGCAATT ATCCAGGCAG GTGA[C/T]GAC AACTTGATGCA GGAAATCAACC A | C | T | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 935–936 | cg43980653 | 1001 | CCCCCTCAGC CATTGCCATG AGGG[C/gap]CT CCACGTTGTCT GATGGTCGCT GG | C | gap | | | SILENT-NONCODING | | | | 18 |
| 937–938 | cg43981661 | 577 | TCATGAGCCCG CTGACCCGGT GGGC[C/T]GAG GGCAGGTAGG GAGACTTCCTC G | C | T | | | SILENT-NONCODING | | | | 17 |
| 939–940 | cg43982025 | 488 | TGGGAAGGCG CATATCCTGGC GGCA[G/gap]CA GCACGTGGCA CCAGGTGCCA GGC | G | gap | | | SILENT-NONCODING | | | | 19 |
| 941–942 | cg43982782 | 1142 | GGTCCCTGCC ACAGCCGTGG AGGGC[G/C]GA CGTGACCTACG CGGCCATGGT GG | G | C | | | SILENT-NONCODING | | | | 4 (4p16.3) |
| 943–944 | cg43983035 | 1104 | CAGGCGGACC TGGAGGTGTCA GCCA[T/C]GGC CCTGACCACTT CAGAAGCCAAC | T | C | | | SILENT-NONCODING | | | | 5 (5q31.3) |
| 945–946 | cg43983194 | 196 | GGCCAACCAT GAGGAGTGCA AAGGG[T/C]GG CACCGGCCAG TGCCCCTGGA CAC | T | C | | | SILENT-NONCODING | | | | 17 |
| 947–948 | cg43983194 | 451 | GCAGCCATGC GCACCTCCAC GCACG[G/A]CC GAGCTCAACCC GAAGACCACG CG | G | A | | | SILENT-NONCODING | | | | 17 |
| 949–950 | cg43983314 | 730 | CAAATGGCAAC ATAATGAAATC ACT[T/C]TCTGC ATCCAGAATTA | T | C | | | SILENT-NONCODING | | | | |

TABLE 1-continued

| Seq ID | CuraGen sequence ID | Base pos. of SNP | Polymorphic sequence | Base before | Base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 951–952 | cg43983314 | 733 | CACCCCCAA ATGGCAACATA ATGAAATCACT TTC[T/A]GCATC CAGAATTACAC CCCCAAGGT | T | A | | | SILENT-NONCODING | | | | |
| 953–954 | cg43983314 | 856 | CCGCGAGGTG CCCTATGCCTA CATC[C/T]GTGA GGGCCATGAG AAGCAGGCCG A | C | T | | | SILENT-NONCODING | | | | |
| 955–956 | cg43984242 | 307 | AGCTCATCCAG CTGGACCAGG CGAA[C/gap]CC CTGGCCGCTG TGCTGAAGGA GGT | C | gap | | | SILENT-NONCODING | | | | |
| 957–958 | cg43986540 | 1009 | GACACCGCCT GGCCTGGTGC TCCAG[G/A]GG TGAAGCAGGC CAGAATCCTGG GG | G | A | | | SILENT-NONCODING | | | | 17 |
| 959–960 | cg43987682 | 1309 | AGCCCTTCTCC AGCACCTTGGC AAA[A/G]ATGTC CGTCAGCACCT CTTTGATGG | A | G | | | SILENT-NONCODING | | | | 9 |
| 961–962 | cg43991793 | 915 | CCCCTGTGCCA TCATTTGGGCC CCC[C/T]AGAC ACTGGAGGAC AGCGTGAGATA | C | T | | | SILENT-NONCODING | | | | 19 (19q13.1) |
| 963–964 | cg43991835 | 194 | AAAAGCGGCG AGGAACGCTTG AAGG[A/G]AAT GGAGGCGGAG ATGGCCCTGTT T | A | G | | | SILENT-NONCODING | | | | 18 |
| 965–966 | cg43994222 | 230 | CACAGAGATTT TACATCACCTT TCA[G/A]AACG CAACAGGGTC CGGGACAGGG | G | A | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 967–968 | cg43995297 | 288 | AGGATCCCTG GCTCGCGTCC CCAAC[C/T]GG TTCCGTGTCTC ACCTGGGTCCT A | C | T | | | SILENT-NONCODING | | | | |
| 969–970 | cg43995517 | 460 | TGGCCGTAGG AGAAAATACAA CCCT[A/G]CCC GGAACAGCAAT AGCTCCCGCC G | A | G | | | SILENT-NONCODING | | | | 12 |
| 971–972 | cg43995517 | 516 | TTACCTTGGAA CCCAGCCTAC AGC[C/G]CGAG CAGCTGTCCCT CTGCCTCCCC A | C | G | | | SILENT-NONCODING | | | | 12 |
| 973–974 | cg43995517 | 532 | CCCTACAGCCC GAGCAGCTGT CCCT[C/T]TGCC TCCCCGGGCC CGCCCTGGCC G | C | T | | | SILENT-NONCODING | | | | 12 |
| 975–976 | cg43997174 | 735 | GGTCATCACAC ACAAGTGGACC ACC[A/G]GCCT GAGTGCAAAAT TCAAGTGCAC | A | G | | | SILENT-NONCODING | | | | 1 (1p13.1) |
| 977–978 | cg43997490 | 511 | AACATGAGGAC CCTCTGGATTA ATC[G/A]AATTA CAGCTGCTAGC CAGGAACAT | G | A | | | SILENT-NONCODING | | | | 1 |
| 979–980 | cg43997710 | 242 | ATGTGAGGTGT GACCTCACGAA GAA[G/A]CAAAT TTAATATTATAA TGGGAAGC | G | A | | | SILENT-NONCODING | | | | |
| 981–982 | cg43997768 | 261 | AGATCCAAAG CCCAGTACACA AGT[A/G]TCTAC GGAGCCCTCA AGAAAATCAT | A | G | | | SILENT-NONCODING | | | | 8 |
| 983–984 | cg43999766 | 367 | CATGTGAAGAG | gap | T | | | SILENT- | | | | 17 |

TABLE 1-continued

| Seq ID | CuraGen sequence ID | Base pos. of SNP | Polymorphic sequence | Base before | Base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 985–986 | cg44000102 | 879 | ACCCAGCCTCT TCA[gap/T]AGG GTATCCAAGAT AAACTTCCGTT | T | gap | | | NONCODING SILENT-NONCODING | | | | X |
| 987–988 | cg44000102 | 880 | CTTATTCTTCTT TGAATACAATG AC[T/gap]TCTG GCACTGATCG GGTCAGTTTCT | T | gap | | | SILENT-NONCODING | | | | X |
| 989–990 | cg44000102 | 882 | TTATTCTTCTTT GAATACAATGA CT[T/gap]CTGG CACTGATCGG GTCAGTTTCT | T | gap | | | SILENT- | | | | X |
| 991–992 | cg44000241 | 412 | ATTCTTCTTTGA ATACAATGACT TC[T/gap]GGCA CTGATCGGGTC AGTTTCTTCC | gap NON-CODING | T | | | SILENT-NONCODING | | | | |
| 993–994 | cg44001933 | 566 | CTCCCTCACGG AGCCAGCGGC CGGG[gap/T]AA TGCAGACATCA GAACGTGAGG GG | gap | T | | | SILENT-NONCODING | | | | |
| 995–996 | cg44002491 | 17 | CTCCGCGCAC AGTGGTGGCC ACCGC[C/G]AC TGGTGCTGAAG TGTCGGCGTGT | C | G | | | SILENT-NONCODING | | | | |
| 997–998 | cg44003839 | 280 | GCGCGCCCTT CTTCCC[T/C]TA CTGCGAGGAG CCACCGCCTCT TT | T | C | | | SILENT-NONCODING | | | | |
| 999–1000 | cg44003987 | 1374 | CCCCATCACCA GGCGGTTCTC CCCG[A/G]TCT CCAGCGCAG CCCCAGGGCT CC | A | G | | | SILENT-NONCODING | | | | |
| | | | CACACGCACAC GTACATTCACT ACA[A/C]ACGT | A | C | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 1001–1002 | cg44005542 | 627 | GCAGCCTCCT GCACACGTGC A TCCTAATCCCA TGCCAGAACC GAAG[G/gap]CT AATGGCCACAT TCTTCTTTTAAA | G | gap | | | SILENT-NONCODING | | | | |
| 1003–1004 | cg44007769 | 1257 | GGGTCTGCTG AGTTGGAGGA GTGCA[A/T]TGT CGCCCTGGGA GCCCTCCTGG AG | A | T | | | SILENT-NONCODING | | | | |
| 1005–1006 | cg44009153 | 928 | AGCCATGGGTT TGGGTAATAAG AAG[A/G]GAGA GCATTTGGGGT TCAAGAGAGG | A | G | | | SILENT-NONCODING | | | | |
| 1007–1008 | cg44009645 | 5337 | CTTTTCCATGT GGCTCAATATC AAC[T/C]TTTCC CGTCTAATGAT GACAAATCT | T | C | | | SILENT-NONCODING | | | | |
| 1009–1010 | cg44012500 | 579 | GGCATCTCATC TTGCTGGGGCT GTT[G/gap]GGT CCCCTGGACCT CAAATCCCAAT | G | gap | | | SILENT-NONCODING | | | | 19 (19q13.2) |
| 1011–1012 | cg44014720 | 482 | CAGAGCCCTGT CGTGGCCCTG TCCA[T/C]CTCC TGCGCCAGGA AACACAGGTTC | T | C | | | SILENT-NONCODING | | | | |
| 1013–1014 | cg44020161 | 854 | CTCCAAGAGTT CTGGTCTCCCG CGA[G/gap]GG GCGGAGTTCC CTCCCCAGTCC CG | G | gap | | | SILENT-NONCODING | | | | 17 |
| 1015–1016 | cg44021014 | 561 | GAGGCACACA GACAGATGATG AGCA[G/A]CTCT TCTCCTTAAAG AAGTCTGTGT | G | A | | | SILENT NONCODING | | | | |

TABLE 1-continued

| Seq ID | CuraGen sequence ID | Base pos. of SNP | Polymorphic sequence | Base before | Base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 1017–1018 | cg44024536 | 1149 | AGGGTGTGTGT GTGTGTGTGTG TGT[G/A]TGTGT GTGTGTGTGCG TGTGCG | G | A | | | SILENT-NONCODING | | | | 9 |
| 1019–1020 | cg44024536 | 1153 | TGTGTGTGTGT GTGTGTGTGTG TGT[G/A]TGTGT GTGTGCGTGTG CG | G | A | | | SILENT-NONCODING | | | | 9 |
| 1021–1022 | cg44026832 | 299 | TGGCTGCAGA GGTTGAGCCTC CTGA[G/A]CCC CTGCTTGGTGA CAAGGGACCT G | G | A | | | SILENT NONCODING | | | | X |
| 1023–1024 | cg44026832 | 446 | CTTCTGGGCTG TGGCCCTGCTC TTG[C/T]TGGCT ACTCTCATGGA GCAGGGCTT | C | T | | | SILENT-NONCODING | | | | X |
| 1025–1026 | cg44029982 | 1149 | GGCTGTAGGG GATGTTGGTCT CCTG[G/A]AAAA AGGCGCTGAG GGCTGTCTCGA | G | A | | | SILENT-NONCODING | | | | 14 |
| 1027–1028 | cg44030164 | 245 | GGGTGTAGAC GCTGCTGGCC AGCCC[g/T]CC GCAGCCGAGG TTCTCGGCACC GC | G | T | | | SILENT-NONCODING | | | | |
| 1029–1030 | cg44031677 | 249 | CAGACCCGAG GTGCCCAGGG CATTC[C/T]GGA GGCAGCCGAG GGCAGCAGCT CC | C | T | | | SILENT-NONCODING | | | | 1 |
| 1031–1032 | cg44031863 | 401 | GGACTTCTGCT GCGTCTTCGG | C NON-CODING | T | | | SILENT- | | | | |
| 1033–1034 | cg44033624 | 1409 | CCAC[C/T][TCTC CTCTTGCCTTT TGGTGGACCC GAAAAGGGATA | G | gap | | | SILENT- | | | | 10 |

TABLE 1-continued

| Seq ID | CuraGen sequence ID | Base pos. of SNP | Polymorphic sequence | Base before | base after | Amino acid before | Amino acid after | Type of change | Protein classification of Name of protein identified following a BLASTX analysis of the CuraGen sequence | BLASTX analysis | Similarity (pValue) following a location | Map |
|---|---|---|---|---|---|---|---|---|---|---|---|---|
| 1035–1036 | cg44033878 | 1552 | CTTTGATAATTA AG[G/gap]CCAG AGGCCCATTAG TTGAGAAAGT AAGGAGGGAT | T | G | | | NONCODING SILENT-NONCODING | | | | (7q31) 1 |
| 1037–1038 | cg44034830 | 701 | ATGTTCCACGT AACT[T/G]GCTG GGACTGTACCC AAGAATTAAA GCAGGAGCCT GCAGGAGGCT GAAAA[G/A]TC AGGCTAGGGA TATAGCAGGGA TG | G | A | | | SILENT-NONCODING | | | | 5 |
| 1039–1040 | cg44127556 | 521 | TGGCGACGAC TCTGGAGTGG CGGAT[A/G]CG GGGAGGGCGG ATGTCCCTGGG TC | A | G | | | SILENT-NONCODING | | | | 19 |
| 1041–1042 | cg44128344 | 137 | CCCCAGGATTC TGGCCTGCTTC ACC[T/C]CTGG AGCACCAGGC CAGGCGGTGT C | T | C | | | SILENT-NONCODING | | | | 21 |
| 1043–1044 | cg44131644 | 894 | TGGCCCCCGA CGAGCTGTACA CGCC[G/C]CAC AGCTGGCTGCT CCGCGTGGTAT | G | C | | | SILENT-NONCODING | | | | 15 |
| 1045–1046 | cg44911913 | 967 | AGGGCGGCTG CGGGGCTGCC CCTGG[C/T]CC CCCGGCCCCT CCTGGGCGCC CTC | C | T | | | SILENT-NONCODING | | | | 15 |
| 1047–1048 | cg44911913 | 992 | CCCCCCGGCC CCTCCTGGGC GCCCT[C/G]GT CCGGCTCCTG GCCCTGCTCC CTG | C | G | | | SILENT-NONCODING | | | | 15 |
| 1049–1050 | cg44912347 | 853 | TCTTTACATTA | A | G | | | SILENT- | | | | 11 |

TABLE 1-continued

| Seq ID | CuraGen sequence ID | Base pos. of SNP | Polymorphic sequence | Base before | Base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 1051–1052 | cg44913333 | 159 | GAGCCAATTTAAGA[A/G]GGCGCTGGTATGTATGAGCTTTTTG | | | | | NONCODING | | | | 12 |
| 1053–1054 | cg44914547 | 175 | CTCCCCAGAATTCCTAGACTGGGTT[A/G]ATAGGGTCATATTGTGAATGTCTCA | A | G | | | SILENT-NONCODING | | | | |
| 1055–1056 | cg44914547 | 86 | GGTCCCCCTGCTTCTTCCCTGCAGA[C/T]ATGGTGGAGCTGCTGCTGCTGCAGA | C | T | | | SILENT-NONCODING | | | | |
| 1057–1058 | cg44914864 | 641 | GGACCTGCACAGTGTACAGACACAC[G/C]TGTTCTCTGGTCCTATAATGCTCTA | G | C | | | SILENT-NONCODING | | | | |
| 1059–1060 | cg44915149 | 857 | GCTCCGATGCGCGATGCATTCATAG[T/C]GTCGCCTTTCAAGAAAGTTCGGTGT | T | C | | | SILENT-NONCODING | | | | |
| 1061–1062 | cg44916019 | 445 | GGGTCATCGACCCCATTGATGGCAC[C/T]AAGAACTTCGTGCACGGGTCTGTTG | C | T | | | SILENT-NONCODING | | | | 22 |
| 1063–1064 | cg44916367 | 200 | CCCCTACCTGGCCTGGCTGGCCTTC[A/G]CGACCACACTCAACTACTGCGTATG | A | G | | | SILENT-NONCODING | | | | |
| 1065–1066 | cg44916367 | 248 | GGTGCCACCAGGCTCTTTTTAACAA[A/G]CAGTTCTCACAGAAACTAATCAAGT | A | G | | | SILENT-NONCODING | | | | |
| | cg44916367 | | AGTGAGAACTCACTTGTTACCACAA[A/G]GATGGCACCAGGCTATTCATGAAGG | A | G | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 1067–1068 | cg44919480 | 413 | GCCACGAAGT GATTGTGTCTG CAGC[A/G]TGT GGGCGGAACC ACACCTTGGCC T | A | G | | | SILENT-NONCODING | | | | |
| 1069–1070 | cg44919480 | 504 | GATGGGGCAG CTGGGCCTTG GCAAC[C/T]AG ACAGACGCTGT TCCCAGCCCC GC | C | T | | | SILENT-NONCODING | | | | |
| 1071–1072 | cg44919623 | 302 | GCCCGCTGCG ATATGTCGTCC TTTG[G/A]GAAC CTCAGCAGCA GCGTAAGTC | G | A | | | SILENT-NONCODING | | | | |
| 1073–1074 | cg44919623 | 307 | CTGCGATATGT CGTCCTTTGGG AAC[C/T]TCAGC AGCCAGCCGT AAGTCCTCAC | C | T | | | SILENT-NONCODING | | | | |
| 1075–1076 | cg44920877 | 23 | ACGCGTTCTGC GAGGCCATGC G[G/A]GTCTAT GCCCCGCGGC CGTTGGCCT | G | A | | | SILENT-NONCODING | | | | |
| 1077–1078 | cg44920877 | 27 | CGCGTTCTGC GAGGCCATGC GGGTC[T/C]AT GCCCCGCGGC CGTTGGCCTC GCC | T | C | | | SILENT-NONCODING | | | | |
| 1079–1080 | cg44920877 | 45 | GCGGGTCTAT GCCCCGCGGC CGTTG[G/A]CC TCGCCCACACC CCGGCCCCA CT | G | A | | | SILENT-NONCODING | | | | |
| 1081–1082 | cg44920877 | 58 | CCGCGGGCCGT TGGCCTCGCC CACAC[C/T]CC CGGCCCCACT GCCGGTGGAG AGA | C | T | | | SILENT-NONCODING | | | | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 1083–1084 | cg44920877 | 68 | TGGCCTCGCC CACACCCCG GCCCC[A/G]CT GCGGGTGGAG AGACGTCGGG CCC | A | G | | | SILENT-NONCODING | | | | |
| 1085–1086 | cg44923068 | 71 | CGGACACCCG GCGGGAGCTG GCGGA[G/gap]C TCGTGAAGCG GAAGCAGGAG CTGG | G | gap | | | SILENT-NONCODING | | | | 1 |
| 1087–1088 | cg44928274 | 452 | AGCAAGGGGA AGATCATCAGC GGCA[G/gap]CA GCGGCAGCCT GCTGTCTTCAG GT | G | gap | | | SILENT-NONCODING | | | | |
| 1089–1090 | cg44928732 | 299 | GTGTACCAGC GCCTGATCCG GGACA[T/G]TC CCTGCCGCAC GGTCAGCGCCT GAC | T | G | | | SILENT-NONCODING | | | | |
| 1091–1092 | cg44932136 | 964 | ACAGACGCGC ACACACACGC GCACA[gap/C]g ACGCACACACA GACGCACACA CGC | gap | C | | | SILENT-NONCODING | | | | |
| 1093–1094 | cg44932136 | 976 | ACACACGCGC ACAGACGCACA CACA[gap/A]GA CGCACACACG CACAGACACAC AC | gap | A | | | SILENT-NONCODING | | | | |
| 1095–1096 | cg44932184 | 644 | TGGGCACGAG CGTGGCTTCG GCGGA[G/gap]C AGGATGAACTG TCTCAGAGACT GG | G | gap | | | SILENT-NONCODING | | | | |
| 1097–1098 | cg44938456 | 2706 | TGACCTTGACC AGTTTGATCAG TTA[C/T]TGCCC | C | T | | | SILENT-NONCODING | | | | 2 |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 1099–1100 | cg44938456 | 2729 | ACGCTGGAGA AGGCAGCACA TACTGCCCACG CTGGAGAAGG CAGC[A/G]CAG TTGCCAGGCTT ATGTGAGACAG | A | G | | | SILENT-NONCODING | | | | 2 |
| 1101–1102 | cg44938456 | 2738 | CGCTGGAGAA GGCAGCACAG TTGCC[A/G]GG CTTATGTGAGA CAGACAGGAT GG | A | G | | | SILENT-NONCODING | | | | 2 |
| 1103–1104 | cg44938456 | 2744 | AGAAGGCAGC ACAGTTGCCAG GCTT[A/G]TGTG AGACAGACAG GATGGATGGT | A | G | | | SILENT-NONCODING | | | | 2 |
| 1105–1106 | cg44938456 | 2775 | GACAGACAGG ATGGATGGTGC GGTC[A/C]CCA GTGTAACCATC AAATCGGAGAT | A | C | | | SILENT-NONCODING | | | | 2 |
| 1107–1108 | cg44938456 | 2792 | GTGCGGTCAC CAGTGTAACCA TCAAA[A/G]TCG GAGATCCTGCC AGCTTCACTTC | A | G | | | SILENT-NONCODING | | | | 2 |
| 1109–1110 | cg44938456 | 2807 | TAACCATCAAA TCGGAGATCCT GCC[A/C]GCTT CACTTCAGTCC GCCACTGCCA | A | C | | | SILENT-NONCODING | | | | 2 |
| 1111–1112 | cg5633308 | 186 | ACAAGGGGAA CATCAACACAA GAGA[A/T]GCC TACAAAGGGC GAGCGTGCAA GC | A | T | | | SILENT-NONCODING | | | | |
| 1113–1114 | cg32160481 | 124 | GAGATGGGGG TCATGGCGCC CCGAA[C/G]CC TCCTCCTGCTG CTCTCAGGGG CC | C | G | Thr (1193) | Ser (1194) | CONSERVATIVE | MHC | Human Gene Similar to SWISSPROT-ID: P30508 HLA CLASS 1 HISTOCOMPATIBILITY ANTIGEN, CW*1201 ALPHA CHAIN PRECURSOR (HLA-CX52) - HOMO SAPIENS (HUMAN), 366 aa. | 5.60E-37 | |

TABLE 1-continued

| Seq ID | CuraGen sequence ID | Base pos. of SNP | Polymorphic sequence | Base before | Base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 1115–1116 | cg32160481 | 164 | TCTCAGGGGC CCTGGCCCTG ACCGA[G/T]AC CTGGGCGGGT GAGTGCGGGG TCG | G | T | Glu (1195) | Asp (1196) | CONSERVATIVE | MHC | Human Gene Similar to SWISSPROT-ID: P30508 HLA CLASS 1 HISTOCOMPATIBILITY ANTIGEN, CW*1201 ALPHA CHAIN PRECURSOR (HLA-CX52) - HOMO SAPIENS (HUMAN), 366 aa. | 5.60E-37 | |
| 1117–1118 | cg27790564 | 65 | AGCTTGAGCAG AGCCTTGACCT TCT[A/G]CACAC AAACTGTTAGT GTCGGTGTT | A | G | Val (1197) | Ala (1198) | CONSERVATIVE | protease | Human Gene Similar to SWISSNEW-ID: P53616 PROTEASOME COMPONENT SUN4 - SACCHAROMYCES CEREVISIAE (BAKER'S YEAST), 420 aa.| pcls: SWISSPROT-ID: P53616 PROTEASOME COMPONENT SUN4 - SACCHAROMYCES CEREVISIAE (BAKER'S YEAST), 420 aa. | 9.70E-31 | |
| 1119–1120 | cg43967452 | 418 | GCGTTACCGG CTGCAGCGGC GGGAG[G/A]AC TACACGCGCTA CAACCAGCTGA | G | A | Asp (1199) | Asn (1200) | CONSERVATIVE | ribosomalprotrot | Human Gene Similar to SWISSPROT-ID: P32899 PUTATIVE 40S RIBOSOMAL PROTEIN YHR148W - SACCHAROMYCES CEREVISIAE (BAKER'S YEAST), 183 aa. | 2.80E-49 | 15 |
| 1121–1122 | cg39548335 | 302 | TGTATTCTCGT TGTTACCGGCG GCC[T/C]TCCT GGGAGTGCTC | T | C | Lys (1201) | Arg (1202) | CONSERVATIVE | UNCLASSIFIED | Human Gene Similar to SWISSPROT-ACC: | 2.90E-48 P43618 HYPOTHETICAL 41.3 KD PROTEIN IN SAP155-YMR31 INTERGENIC REGION - Saccharomyces cerevisiae (Baker's yeast), 361 aa. | |
| 1123–1124 | cg38435145 | 132 | ATTATTCATTT TGCTGGAGAAT TTGGCCACAAA GAG[C/T]TGCC AAGATAGCTGG GCCAGGAAGA | C | T | Ala (1203) | Val (1204) | CONSERVATIVE | UNCLASSIFIED | Human Gene Similar to TREMBLNEW-ACC: BM74914 KIAA0891 PROTEIN - HOMO SAPIENS (HUMAN), 1371 aa (fragment). | 4.10E-46 | |
| 1125–1126 | cg42894694 | 1008 | TTTTGTATTTTT AGTAGAGACG GGG[T/C]TTCA CCATGTTGGCC AGGCTGGTCT | T | C | Val (1205) | Ala (1206) | CONSERVATIVE | UNCLASSIFIED | Human Gene Similar to SWISSPROT-ACC: P39194 !!!! ALU SUBFAMILY SQ WARNING ENTRY - Homo sapiens (Human), 593 aa. | 8.30E-34 | |
| 1127–1128 | cg27847601 | 281 | TGAGGTGGGA GGACTGCCTG AACCA[A/G]GG AGGTGGAGGC TGCAGTGAGC CAA | A | G | Lys (1207) | Arg (1208) | CONSERVATIVE | UNCLASSIFIED | Human Gene Similar to SWISSPROT-ACC: P39191 !!!! ALU SUBFAMILY SB2 WARNING ENTRY - Homo sapiens (Human), 603 aa. | 1.00E-31 | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| 1129–1130 | cg43976973 | 1025 | GTGAGCATCAT GATGCTGCTGT CGG[C/G]TTCG GGGGGCAGCA CGTCCACCAGT | C | G | Lys (1209) | Asn (1210) | NON-CONSERVATIVE | ATPase associated | Human Gene Similar to TREMBLNEW-ID: G263099 TAT BINDING PROTEIN 7, TBP-7 = TRANSCRIPTIONAL ACTIVATOR - HOMO SAPIENS, 458 aa. | 3.50E-33 | |
| 1131–1132 | cg43925450 | 848 | GCAACTGGTG CTCCAGGCCG AAACC[G/T]AG GTGTGGACCTC CAGGAGAACAA C | G | T | Arg (1211) | Leu (1212) | NON-CONSERVATIVE | glycoprotein | Human Gene Similar to TREMBLNEW-ID: E1249608 MEMBRANE-BOUND SMALL GTP-BINDING - LIKE PROTEIN - ARABIDOPSIS THALIANA (MOUSE-EAR CRESS), 217 aa. | 3.80E-37 | 17 |
| 1133–1134 | cg43305492 | 342 | CTCCAAAACC AGGTGGTCCTT ACA[A/C]TGACC AACATGGACCC TGTGGACAC | A | C | Met (1213) | Leu (1214) | NON-CONSERVATIVE | immunoglob | Human Gene Similar to TREMBLNEW-ID: G2734101 IMMUNOGLOBULIN HEAVY CHAIN, VD(5)J(4) LIKE GENE PRODUCT - HOMO SAPIENS (HUMAN), 151 aa. | 7.40E-49 | |
| 1135–1136 | cg34758710 | 463 | GGGCATCATTG CTGGCCTGGTT GTC[C/T]TTGCA GCTGTAGTCAC TGGAGCTGC | C | T | Leu (1215) | Phe (1216) | NON-CONSERVATIVE | MHC | Human Gene Similar to SPTREMBL-ID: Q30916 MHC CLASS A - PAN TROGLODYTES (CHIMPANZEE), 357 aa (fragment). | 2.20E-39 | |
| 1137–1138 | cg43923640 | 511 | TCCGCTGAGG AAATTCAAGCT GGTG[T/C]TCCT GGGGGAGCAA AGCGTTGGAAA | T | C | Phe (1217) | Leu (1218) | NON-CONSERVATIVE | oncogene | Human Gene Similar to SWISSPROT-ID: P24407 RAS-RELATED PROTEIN RAB-8 (ONCOGENE C-MEL) - HOMO SAPIENS (HUMAN), AND CANIS FAMILIARIS (DOG), 207 aa. | 1.30E-34 | 1 |
| 1139–1140 | cg27790564 | 15 | GGTACCACAGA TAG[C/T]AATGG AGCCGGAGAC CTTGTTAACA | C | T | Ala (1219) | Thr (1220) | NON-CONSERVATIVE | protease | Human Gene Similar to SWISSNEW-ID: P53616 PROTEASOME COMPONENT SUN4 - SACCHAROMYCES CEREVISIAE (BAKER'S YEAST), 420 aa.\|pcls: SWISSPROT-ID: P53616 PROTEASOME COMPONENT SUN4 - SACCHAROMYCES CEREVISIAE (BAKER'S YEAST), 420 aa. | 9.70E-31 | |
| 1141–1142 | cg39517733 | 241 | CCCTCATCAAA GATGGGGGCT GTTG[G/A]TGG GCACTTGGGG TAGCAGCCTTC C | G | A | Pro (1221) | Ser (1222) | NON-CONSERVATIVE | struct | Human Gene Similar to SPTREMBL-ID: Q14425 GASTRIC MUCIN - HOMO SAPIENS (HUMAN), 850 aa (fragment). | 3.90E-36 | |
| 1144–1143 | cg39517733 | 88 | CCAGCATCAT GGGTACAGTT CACAC[T/C]A CTCTCCGTAC AAACGCAGG AATAA | T | C | Ser (1223) | Gly (1224) | NON-CONSERVATIVE | struct | Human Gene Similar to SPTREMBL-ID: Q14425 GASTRIC MUCIN - HOMO SAPIENS (HUMAN), 850 aa (fragment). | 3.9E-36 | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map a |
|---|---|---|---|---|---|---|---|---|---|---|---|---|
| 1145–1146 | cg39565684 | 240 | TTCTGGGATAA GGTATTGGTAC CAT[C/T]GGGA ATCGCACGCG GATCTAGCATT | C | T | Arg (1225) | Gln (1226) | NON-CONSERVATIVE | synthase | Human Gene Similar to SWISSNEW-ID: P53167 PSEUDOURIDYLATE SYNTHASE 2 (EC 4.2.1.70) (PSEUDOURIDINE SYNTHASE 2) - SACCHAROMYCES CEREVISIAE (BAKER'S YEAST), 370 aa.^pcls: SWISSPROT-ID: P53167 PSEUDOURIDYLATE SYNTHASE 2 (EC 4.2.1.70) (PSEUDOURIDINE SYNTHASE 2) - SACCHAROMYCES CEREVISIAE (BAKER'S YEAST), 370 aa.|pcls: SPTREMBL-ID: Q06713 PSEUDOURIDINE SYNTHASE 2 - SACCHAROMYCES CEREVISIAE (BAKER'S YEAST), 370 aa. | 1.40E-33 | |
| 1147–1148 | cg32152874 | 143 | CAAGGTGTACG TGTCCATgCCG GCC[A/C]TgGC CATGCACCTGC TCACGCACGA | A | C | Met (1227) | Leu (1228) | NON-CONSERVATIVE | transcriptfactor | Human Gene Similar to SPTREMBL-ID: Q24140 NEURON SPECIFIC ZINC FINGER TRANSCRIPTION FACTOR - DROSOPHILA MELANOGASTER (FRUIT FLY), 664 aa. | 1.50E-39 | |
| 1149–1150 | cg43025141 | 686 | CTACGCCAAGC GCAACGCCCT GCGC[G/A]CCG CCGAGGTGTG GATGGATGACT T | G | A | Ala (1229) | Thr (1230) | NON-CONSERVATIVE | transferase | Human Gene Similar to SPTREMBL-ID: O08832 POLYPEPTIDE GALNAC TRANSFERASE-T4 - MUS MUSCULUS (MOUSE), 578 aa. | 1.10E-49 | |
| 1151–1152 | cg44028935 | 80 | GGCAGGATGA TCAAGCTGTTC TCGC[T/A]GAA GCAGCAGAAG AAGGAGGAGG AG | T | A | Leu (1231) | Gln (1232) | NON-CONSERVATIVE | ubiquitin | Human Gene Similar to SWISSPROT-ID: P52491 UBIQUITIN-CONJUGATING ENZYME E2-21.2 KD (EC 6.3.2.19) (UBIQUITIN-PROTEIN LIGASE) (UBIQUITIN CARRIER PROTEIN) - SACCHAROMYCES CEREVISIAE (BAKER'S YEAST), 188 aa. | 3.00E-36 | 8 |
| 1153–1154 | cg44028935 | 82 | CAGGATGATCA AGCTGTTCTCG CTG[A/C]AGCA GCAGAAGAAG GAGGAGGAGT C | A | C | Lys (1233) | Gln (1234) | NON-CONSERVATIVE | ubiquitin | Human Gene Similar to SWISSPROT-ID: P52491 UBIQUITIN-CONJUGATING ENZYME E2-21.2 KD (EC 6.3.2.19) (UBIQUITIN-PROTEIN LIGASE) (UBIQUITIN CARRIER PROTEIN) - SACCHAROMYCES CEREVISIAE (BAKER'S YEAST), 188 aa. | 3.00E-36 | 8 |
| 1155–1156 | cg44028935 | 83 | AGGATGATCAA GCTGTTCTCGC TGA[A/T]gCAG CAGAAGAAGG AGGAGGAGTC | A | T | Lys (1235) | Met (1236) | NON-CONSERVATIVE | ubiquitin | Human Gene Similar to SWISSPROT-ID: P52491 UBIQUITIN-CONJUGATING ENZYME E2-21.2 KD (EC 6.3.2.19) (UBIQUITIN-PROTEIN LIGASE) (UBIQUITIN CARRIER PROTEIN) - SACCHAROMYCES CEREVISIAE (BAKER'S YEAST), 188 aa. | 3.00E-36 | 8 |
| 1157–1158 | cg44028935 | 86 | ATGATCAAGCT GTTCTCgCTgA AGC[A/G]gCAG AAGAAGGAGG AGG | A | G | Gln (1237) | Arg (1238) | NON-CONSERVATIVE | ubiquitin | Human Gene Similar to SWISSPROT-ID: P52491 UBIQUITIN-CONJUGATING ENZYME E2-21.2 KD (EC 6.3.2.19) (UBIQUITIN-PROTEIN LIGASE) (UBIQUITIN CARRIER PROTEIN) - SACCHAROMYCES CEREVISIAE (BAKER'S YEAST), 188 aa. | 3.00E-36 | 8 |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a location | Map |
|---|---|---|---|---|---|---|---|---|---|---|---|---|
| | | | AGGAGTCGGC | | | | | | | SACCHAROMYCES CEREVISIAE (BAKER'S YEAST), 188 aa. | | |
| 1159–1160 | cg39548335 | 228 | ATCAGTACCTC ATCCTTGAGAC GTT[G/A]TTCTT CAAGGGCTCTC TCCCGAAAG | G | A | Gln (1239) | End (1240) | NON-CONSERVA-TIVE | UNCLASSI-FIED | Human Gene Similar to SWISSPROT-ACC: P43618 HYPOTHETICAL 41.3 KD PROTEIN IN SAP155-YMR31 INTERGENIC REGION - *Saccharomyces cerevisiae* (Baker's yeast), 361 aa. | 2.90E–48 | |
| 1161–1162 | cg39548335 | 48 | TCATCTATTAG ATTCCGTGCTT GAG[T/C]TTAT TAGTAGTTGTA TCGTTGCCT | T | C | Thr (1241) | Ala (1242) | NON-CONSERVA-TIVE | UNCLASSI-FIED | Human Gene Similar to SWISSPROT-ACC: P43618 HYPOTHETICAL 41.3 KD PROTEIN IN SAP155-YMR31 INTERGENIC REGION - *Saccharomyces cerevisiae* (Baker's yeast), 361 aa. | 2.90E–48 | |
| 1163–1164 | cg39510144 | 109 | ATTGGGTTGTA TGCAGAACTCT ATC[C/T]ATGCG GGGAATGTTCA TATCACTTT | C | T | Pro (1243) | Leu (1244) | NON-CONSERVA-TIVE | UNCLASSI-FIED | Human Gene Similar to SWISSPROT-ACC: Q12284 ERV2 PROTEIN PRECURSOR - *Saccharomyces cerevisiae* (Baker's yeast), 196 aa. | 2.00E–47 | |
| 1165–1166 | cg39565075 | 28 | CGGAGAAGAG GAGTCACTGCA CGTG[T/G]TTCA GTATGCTAATA GACCAAGGCT | T | G | Phe (1245) | Val (1246) | NON-CONSERVA-TIVE | UNCLASSI-FIED | Human Gene Similar to SWISSPROT-ACC: P36121 HYPOTHETICAL 32.1 KD PROTEIN IN DBP7-GCN3 INTERGENIC REGION - *Saccharomyces cerevisiae* (Baker's yeast), 282 aa. | 1.40E–46 | |
| 1167–1168 | cg21427396 | 193 | TCAAACCCATG GTCGAGAGTG GGAG[C/T]GTT ATGCCATGGTT AAAGCCCGTGT | C | T | Arg (1247) | Cys (1248) | NON-CONSERVA-TIVE | UNCLASSI-FIED | Human Gene Similar to SWISSPROT-ACC: P30870 GLUTAMATE-AMMONIA-LIGASE ADENYLYL-TRANSFERASE (EC 2.7.7.42) (GLUTAMINE-SYNTHETASE ADENYLYLTRANSFERASE) (ATASE) - *Escherichia coli*, 946 aa. | 7.60E–44 | |
| 1169–1170 | cg34394308 | 431 | GTTGATGCTGC TCAGCCGGCG CACG[G/A]CAC GCCTCCAGAAT TGTGCTACTCG | G | A | Gly (1249) | Asp (1250) | NON-CONSERVA-TIVE | UNCLASSI-FIED | Human Gene Similar to SWISSPROT-ACC: P50442 GLYCINE AMIDINOTRANSFERASE PRE-CURSOR (EC 2.1.4.1) (L-ARGININE:GLYCINE AMIDINOTRANSFERASE) (TRANSAMIDINASE) (AT) - *Rattus norvegicus* (Rat), 423 aa. | 1.50E–42 | |
| 1171–1172 | cg43129081 | 415 | CCTCGATCTCC TGACCTCGTGA TCC[G/A]CCCA CCTTGGCCTCC CAAAGTGCTG | G | A | Ala (1251) | Thr (1252) | NON-CONSERVA-TIVE | UNCLASSI-FIED | Human Gene Similar to SWISSPROT-ACC: P39189 !!!! ALU SUBFAMILY SB WARNING ENTRY - *Homo sapiens* (Human), 587 aa. | 3.70E–41 | |
| 1173–1174 | cg29693502 | 197 | CTGATCGACGT ATTCCAACAGC TCA[T/G]TCGTC AACTCCGGTC GCCGGCACC | T | G | Asn (1253) | Thr (1254) | NON-CONSERVA-TIVE | UNCLASSI-FIED | Human Gene Similar to SWISSPROT-ACC: Q10379 PROBABLE GLUTAMATE-AMMONIA-LIGASE ADENYLYLTRANSFERASE (EC 2.7.7.42) (GLUTAMINE-SYNTHETASE ADENYLYLTRANSFERASE) (ATASE) - Mycobacterium | 3.00E–39 | |
| 1175–1176 | cg27850036 | 136 | TAGGTGTCTAG CCAGTCCATGT | C | T | Gly (1255) | Ser (1256) | NON-CONSERVA- | UNCLASSI-FIED | Human Gene Similar to SWISSNEW-ACC: P11653 METHYLMALONYL COA MUTASE ALPHA- | 1.00E–38 | |

TABLE 1-continued

| Seq ID | CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following BLASTX analysis | Similarity (pValue) following location | Map |
|---|---|---|---|---|---|---|---|---|---|---|---|---|
| 1177–1178 | cg43936560 | 1406 | CAC[C/T]GTAGA CGTCCTCGGA GTAGAGGTGA | | | | | TIVE | | SUBUNIT (EC 5.4.99.2) (MCM-ALPHA) - Propionibacterium freudenreichii shermanii, 727 aa. | | |
| 1179–1180 | cg42538578 | 142 | TTGGGCAGCTT ATCTGTGTGCC CAG[G/C]CGGC ATATCTGTGCA TGTGCGTGTG | G | C | Ala (1257) | Pro (1258) | NON-CONSERVA-TIVE | UNCLASSI-FIED | Human Gene Similar to SPTREMBL-ACC: Q69566 !!!! U1102, VARIANT A DNA, COMPLETE VIRION GENOME - HUMAN HERPESVIRUS-6, 413 aa. | 4.70E-36 | |
| 1181–1182 | cg42475469 | 376 | GCAGCACTTG GCCTTCCCTCT GTAA[C/T]AGGT GCCTTGAATTT TGGTAAAGAT | C | T | Cys (1259) | Tyr (1260) | NON-CONSERVA-TIVE | UNCLASSI-FIED | Human Gene Similar to SWISSPROT-ACC: Q09753 BETA-DEFENSIN 1 PRECURSOR (HBD-1) (DEFENSIN, BETA 1) - Homo sapiens (Human), 68 aa. | 7.40E-34 | 8 |
| 1183–1184 | cg27847601 | 280 | CTGACCTCAAG TGATCCACCTG CCT[C/T]AGCCT CCCAAAGTGCT GGGATTACA | C | T | Glu (1261) | Lys (1262) | NON-CONSERVA-TIVE | UNCLASSI-FIED | Human Gene Similar to SWISSPROT-ACC: P39191 !!!! ALU SUBFAMILY SQ WARNING ENTRY - Homo sapiens (Human), 593 aa. | 5.70E-32 | |
| 1185–1186 | cg27847601 | 298 | CTGAGGTGGG AGGACTGCCT GAACC[A/G]AG GAGGTGGAGG CTGCAGTGAG CCA | A | G | Lys (1263) | Glu (1264) | NON-CONSERVA-TIVE | UNCLASSI-FIED | Human Gene Similar to SWISSPROT-ACC: P39194 !!!! ALU SUBFAMILY SB2 WARNING ENTRY - Homo sapiens (Human), 603 aa. | 1.00E-31 | |
| 1187–1188 | cg44931270 | 1970 | CTGAACCAAGG AGGTGGAGGC TGCA[G/A]TGA GCCAAGATCAC AGCACTATGCT | G | A | Val (1265) | Met (1266) | NON-CONSERVA-TIVE | UNCLASSI-FIED | Human Gene Similar to SWISSPROT-ACC: P39191 !!!! ALU SUBFAMILY SB2 WARNING ENTRY - Homo sapiens (Human), 603 aa. | 1.00E-31 | |
| 1189–1190 | cg43925450 | 333 | CGGCGCCGGG AGGCTGTGGG TCTGG[C/gap]T GCGCACGGTC TCGGTCAGCA GAGC | C | gap (1267) | Gln (1268) | His | FRAMESHIFT | collagen | Human Gene Similar to SPTREMBL-ID: Q28396 TYPE II COLLAGEN - EQUUS CABALLUS (HORSE), 1418 aa. | 2.10E-37 | |
| | cg43925450 | 333 | GATCTGTCAAT TTAAGCTGGTT CTG[gap/T]CTG GGGGAGTCTG CGGTAGGCAA AT | gap | T | Leu (1269) | Ser (1270) | FRAMESHIFT | glycoprotein | Human Gene Similar to TREMBLNEW-ID: E1249608 MEMBRANE-BOUND SMALL GTP-BINDING - LIKE PROTEIN - ARABIDOPSIS THALIANA (MOUSE-EAR CRESS), 217 aa. | 3.80E-37 | 17 |

TABLE 1-continued

| CuraGen sequence ID | Base pos. of SNP | Polymorphic sequence | Base before | base after | Amino acid before | Amino acid after | Type of change | Protein classification of BLASTX analysis of the CuraGen sequence | Name of protein identified following a BLASTX analysis | Similarity (pValue) following a BLASTX analysis | Map location |
|---|---|---|---|---|---|---|---|---|---|---|---|
| Seq ID 1191–1192 cg43941918 | 724 | CAGCCACAGTT CGTTTGATCTC CAC[gap/T]CTT GGTCCCTTGG CCGAAAGTGC GC | gap | T | Val (1271) | Ser (1272) | FRAMESHIFT | immunoglob | Human Gene Similar to TREMBLNEW-ID: G240581 IMMUNOGLOBULIN G2B VARIABLE REGION LIGHT CHAIN, AUTOANTOBODY BV04-01 VARIABLE REGION LIGHT CHAIN - MUSSP, 113 aa. | 2.80E-42 | |

SEQUENCE LISTING (1272 sequences)

SEQ ID NO: 1 - DNA, 51 bp, Homo sapiens
  misc_feature (26)...(0): 1 of 2 allelic variants (2 is other entry)
  misc_feature (0)...(0): Accession number cg34158766
tcgggctcgtccagccaaagcagctgccactcaaaagaaagtagaaagaaa

SEQ ID NO: 2 - DNA, 51 bp, Homo sapiens
  misc_feature (26)...(0): 2 of 2 allelic variants (1 is other entry)
  misc_feature (0)...(0): Accession number cg34158766
tcgggctcgtccagccaaagcagctaccactcaaaagaaagtagaaagaaa

SEQ ID NO: 3 - DNA, 51 bp, Homo sapiens
  misc_feature (26)...(0): 1 of 2 allelic variants (4 is other entry)
  misc_feature (0)...(0): Accession number cg43299481
gtcccggtcagggtgggctgcgggagcctcaggccacggggaagtagtggg

SEQ ID NO: 4 - DNA, 50 bp, Homo sapiens
  misc_feature (26)...(0): 2 of 2 allelic variants (3 is other entry)
  misc_feature (25)...(26): nucleotide deleted between bases 25 and 26
  misc_feature (0)...(0): Accession number cg43299481
gtcccggtcagggtgggctgcgggacctcaggccacggggaagtagtggg

SEQ ID NO: 5 - DNA, 51 bp, Homo sapiens
  misc_feature (26)...(0): 1 of 2 allelic variants (6 is other entry)
  misc_feature (0)...(0): Accession number cg43933536
acaccgggggggcgcgggggtctccctggtccgcagagacagctagctagc

SEQ ID NO: 6 - DNA, 51 bp, Homo sapiens
  misc_feature (26)...(0): 2 of 2 allelic variants (5 is other entry)
  misc_feature (0)...(0): Accession number cg43933536
acaccgggggggcgcgggggtctccttggtccgcagagacagctagctagc

SEQ ID NO: 7 - DNA, 51 bp, Homo sapiens
  misc_feature (26)...(0): 1 of 2 allelic variants (8 is other entry)
  misc_feature (0)...(0): Accession number cg44021557
tgatatccaggctgaatctatcccattgatcttaggaggaggtgatgtact

SEQ ID NO: 8 - DNA, 51 bp, Homo sapiens
  misc_feature (26)...(0): 2 of 2 allelic variants (7 is other entry)
  misc_feature (0)...(0): Accession number cg44021557
tgatatccaggctgaatctatcccactgatcttaggaggaggtgatgtact

SEQ ID NO: 9 - DNA, 50 bp, Homo sapiens
  misc_feature (26)...(0): 1 of 2 allelic variants (10 is other entry)
  misc_feature (25)...(26): nucleotide deleted between bases 25 and 26
  misc_feature (0)...(0): Accession number cg44021557
gaaagaccaacaggaaggcaaaaaaggaaaaacaacaattaaaactggtg

SEQ ID NO: 10 - DNA, 51 bp, Homo sapiens
  misc_feature (26)...(0): 2 of 2 allelic variants (9 is other entry)
  misc_feature (0)...(0): Accession number cg44021557
gaaagaccaacaggaaggcaaaaaaaggaaaaacaacaattaaaactggtg

SEQ ID NO: 11 - DNA, 51 bp, Homo sapiens
  misc_feature (26)...(0): 1 of 2 allelic variants (12 is other entry)
  misc_feature (0)...(0): Accession number cg43305492
tcaccatcaccaaggacacctccaaaaaccaggtggtccttacaatgacca

SEQ ID NO: 12 - DNA, 51 bp, Homo sapiens
  misc_feature (26)...(0): 2 of 2 allelic variants (11 is other entry)
  misc_feature (0)...(0): Accession number cg43305492
tcaccatcaccaaggacacctccaagaaccaggtggtccttacaatgacca

SEQ ID NO: 13 - DNA, 51 bp, Homo sapiens
  misc_feature (26)...(0): 1 of 2 allelic variants (14 is other entry)
  misc_feature (0)...(0): Accession number cg43941918
gattagaacccaaatagatcaggagctgtggagactgccctggcttctgca

SEQ ID NO: 14 - DNA, 51 bp, Homo sapiens
  misc_feature (26)...(0): 2 of 2 allelic variants (13 is other entry)
  misc_feature (0)...(0): Accession number cg43941918
gattagaacccaaatagatcaggagttgtggagactgccctggcttctgca

SEQ ID NO: 15 - DNA, 51 bp, Homo sapiens
  misc_feature (26)...(0): 1 of 2 allelic variants (16 is other entry)
  misc_feature (0)...(0): Accession number cg42312510
ctactttggaaagtggggtcccatcaagattcagcggcagtggatctggga

SEQ ID NO: 16 - DNA, 51 bp, Homo sapiens
  misc_feature (26)...(0): 2 of 2 allelic variants (15 is other entry)
  misc_feature (0)...(0): Accession number cg42312510
ctactttggaaagtggggtcccatcgagattcagcggcagtggatctggga

SEQ ID NO: 17 - DNA, 51 bp, Homo sapiens
  misc_feature (26)...(0): 1 of 2 allelic variants (18 is other entry)
  misc_feature (0)...(0): Accession number cg43147217
taacctatttattatttatgtatttatttaagcatcaaatatttgtgcaag

SEQ ID NO: 18 - DNA, 51 bp, Homo sapiens
  misc_feature (26)...(0): 2 of 2 allelic variants (17 is other entry)
  misc_feature (0)...(0): Accession number cg43147217
taacctatttattatttatgtatttttttaagcatcaaatatttgtgcaag

SEQ ID NO: 19 - DNA, 51 bp, Homo sapiens
  misc_feature (26)...(0): 1 of 2 allelic variants (20 is other entry)
  misc_feature (0)...(0): Accession number cg20725546
aggccgctgacactctcgttattggtggcggtatggcgtacaccttcctca

SEQ ID NO: 20 - DNA, 51 bp, Homo sapiens
  misc_feature (26)...(0): 2 of 2 allelic variants (19 is other entry)
  misc_feature (0)...(0): Accession number cg20725546
aggccgctgacactctcgttattggcggcggtatggcgtacaccttcctca

SEQ ID NO: 21 - DNA, 51 bp, Homo sapiens
  misc_feature (26)...(0): 1 of 2 allelic variants (22 is other entry)
  misc_feature (0)...(0): Accession number cg32160481
gggaaatggcctctgtggggaggagcgaggggcccgcccggcgggggcgca

SEQ ID NO: 22 - DNA, 51 bp, Homo sapiens
  misc_feature (26)...(0): 2 of 2 allelic variants (21 is other entry)
  misc_feature (0)...(0): Accession number cg32160481
gggaaatggcctctgtggggaggagtgaggggcccgcccggcgggggcgca

SEQ ID NO: 23 - DNA, 51 bp, Homo sapiens
  misc_feature (26)...(0): 1 of 2 allelic variants (24 is other entry)
  misc_feature (0)...(0): Accession number cg29691725
ctcgatgtcgcccgagacatggagatcgtcggcccctcgccaaggcattgc

SEQ ID NO: 24 - DNA, 51 bp, Homo sapiens
  misc_feature (26)...(0): 2 of 2 allelic variants (23 is other entry)
  misc_feature (0)...(0): Accession number cg29691725
ctcgatgtcgcccgagacatggagaccgtcggcccctcgccaaggcattgc

SEQ ID NO: 25 - DNA, 51 bp, Homo sapiens
  misc_feature (26)...(0): 1 of 2 allelic variants (26 is other entry)
  misc_feature (0)...(0): Accession number cg29691725
gagacatggagatcgtcggcccctcgccaaggcattgcaagccgtgatcgg

SEQ ID NO: 26 - DNA, 51 bp, Homo sapiens
  misc_feature (26)...(0): 2 of 2 allelic variants (25 is other entry)
  misc_feature (0)...(0): Accession number cg29691725
gagacatggagatcgtcggcccctcaccaaggcattgcaagccgtgatcgg

SEQ ID NO: 27 - DNA, 51 bp, Homo sapiens
  misc_feature (26)...(0): 1 of 2 allelic variants (28 is other entry)
  misc_feature (0)...(0): Accession number cg29691725
cgccaaggcattgcaagccgtgatcgggcatgggccggccctctgtggcgt

SEQ ID NO: 28 - DNA, 51 bp, Homo sapiens
  misc_feature (26)...(0): 2 of 2 allelic variants (27 is other entry)
  misc_feature (0)...(0): Accession number cg29691725
cgccaaggcattgcaagccgtgatcaggcatgggccggccctctgtggcgt

SEQ ID NO: 29 - DNA, 50 bp, Homo sapiens
  misc_feature (26)...(0): 1 of 2 allelic variants (30 is other entry)
  misc_feature (25)...(26): nucleotide deleted between bases 25 and 26
  misc_feature (0)...(0): Accession number cg29691725
cgggcatgggccggccctctgtggcgtcccggaacttttcgcaatcggcc

SEQ ID NO: 30 - DNA, 51 bp, Homo sapiens
  misc_feature (26)...(0): 2 of 2 allelic variants (29 is other entry)
  misc_feature (0)...(0): Accession number cg29691725
cgggcatgggccggccctctgtggccgtcccggaacttttcgcaatcggcc

SEQ ID NO: 31 - DNA, 51 bp, Homo sapiens
  misc_feature (26)...(0): 1 of 2 allelic variants (32 is other entry)
  misc_feature (0)...(0): Accession number cg29691725
cttttcgcaatcggccccgacggcaaatgcgagcaccccggtattccggca

SEQ ID NO: 32 - DNA, 51 bp, Homo sapiens
  misc_feature (26)...(0): 2 of 2 allelic variants (31 is other entry)
  misc_feature (0)...(0): Accession number cg29691725
cttttcgcaatcggccccgacggcagatgcgagcaccccggtattccggca

SEQ ID NO: 33 - DNA, 51 bp, Homo sapiens
  misc_feature (26)...(0): 1 of 2 allelic variants (34 is other entry)
  misc_feature (0)...(0): Accession number cg29691725
tgcgagcaccccggtattccggcattttcacgctgatgagctatgcccgca

SEQ ID NO: 34 - DNA, 51 bp, Homo sapiens
  misc_feature (26)...(0): 2 of 2 allelic variants (33 is other entry)
  misc_feature (0)...(0): Accession number cg29691725
tgcgagcaccccggtattccggcatcttcacgctgatgagctatgcccgca

SEQ ID NO: 35 - DNA, 51 bp, Homo sapiens
  misc_feature (26)...(0): 1 of 2 allelic variants (36 is other entry)
  misc_feature (0)...(0): Accession number cg29691725
gcgagcaccccggtattccggcattttcacgctgatgagctatgcccgcat

SEQ ID NO: 36 - DNA, 51 bp, Homo sapiens
  misc_feature (26)...(0): 2 of 2 allelic variants (35 is other entry)
  misc_feature (0)...(0): Accession number cg29691725
gcgagcaccccggtattccggcattctcacgctgatgagctatgcccgcat

SEQ ID NO: 37 - DNA, 51 bp, Homo sapiens
  misc_feature (26)...(0): 1 of 2 allelic variants (38 is other entry)
  misc_feature (0)...(0): Accession number cg29691725
ttccggcattttcacgctgatgagctatgcccgcatctcccccgcagccag

SEQ ID NO: 38 - DNA, 51 bp, Homo sapiens
  misc_feature (26)...(0): 2 of 2 allelic variants (37 is other entry)
  misc_feature (0)...(0): Accession number cg29691725
ttccggcattttcacgctgatgagccatgcccgcatctcccccgcagccag

SEQ ID NO: 39 - DNA, 51 bp, Homo sapiens
  misc_feature (26)...(0): 1 of 2 allelic variants (40 is other entry)
  misc_feature (0)...(0): Accession number cg29691725
aacatcaaggcggccatcaccgcgccgaaaacgttcatccccctcatcgac

SEQ ID NO: 40 - DNA, 51 bp, Homo sapiens
  misc_feature (26)...(0): 2 of 2 allelic variants (39 is other entry)
  misc_feature (0)...(0): Accession number cg29691725
aacatcaaggcggccatcaccgcgctgaaaacgttcatccccctcatcgac

SEQ ID NO: 41 - DNA, 51 bp, Homo sapiens
  misc_feature (26)...(0): 1 of 2 allelic variants (42 is other entry)
  misc_feature (0)...(0): Accession number cg29691725
acgcccagatcgtcacgacggtcacgcccctcgatgtcgcccgagacatgg

SEQ ID NO: 42 - DNA, 51 bp, Homo sapiens
  misc_feature (26)...(0): 2 of 2 allelic variants (41 is other entry)
  misc_feature (0)...(0): Accession number cg29691725
acgcccagatcgtcacgacggtcacacccctcgatgtcgcccgagacatgg

SEQ ID NO: 43 - DNA, 51 bp, Homo sapiens
  misc_feature (26)...(0): 1 of 2 allelic variants (44 is other entry)
  misc_feature (0)...(0): Accession number cg29691725
tcgtcacgacggtcacgcccctcgatgtcgcccgagacatggagatcgtcg

SEQ ID NO: 44 - DNA, 51 bp, Homo sapiens
  misc_feature (26)...(0): 2 of 2 allelic variants (43 is other entry)
  misc_feature (0)...(0): Accession number cg29691725
tcgtcacgacggtcacgcccctcgacgtcgcccgagacatggagatcgtcg

SEQ ID NO: 45 - DNA, 51 bp, Homo sapiens
  misc_feature (26)...(0): 1 of 2 allelic variants (46 is other entry)
  misc_feature (0)...(0): Accession number cg43986329
gggtttcccatcagcattgccgtcccgggtgtagagtctctcgctggggca

SEQ ID NO: 46 - DNA, 51 bp, Homo sapiens
  misc_feature (26)...(0): 2 of 2 allelic variants (45 is other entry)
  misc_feature (0)...(0): Accession number cg43986329
gggtttcccatcagcattgccgtcctgggtgtagagtctctcgctggggca

SEQ ID NO: 47 - DNA, 51 bp, Homo sapiens
  misc_feature (26)...(0): 1 of 2 allelic variants (48 is other entry)
  misc_feature (0)...(0): Accession number cg20438082
cttcaactgctttagcaacatccatagttacagtaccagttttagggtttg

SEQ ID NO: 48 - DNA, 51 bp, Homo sapiens
  misc_feature (26)...(0): 2 of 2 allelic variants (47 is other entry)
  misc_feature (0)...(0): Accession number cg20438082
cttcaactgctttagcaacatccattgttacagtaccagttttagggtttg

SEQ ID NO: 49 - DNA, 51 bp, Homo sapiens
  misc_feature (26)...(0): 1 of 2 allelic variants (50 is other entry)
  misc_feature (0)...(0): Accession number cg20438082
caaggacacgtccaagacgtccaacaagagccatcatatcaggtgtagcga

SEQ ID NO: 50 - DNA, 51 bp, Homo sapiens
  misc_feature (26)...(0): 2 of 2 allelic variants (49 is other entry)
  misc_feature (0)...(0): Accession number cg20438082
caaggacacgtccaagacgtccaactagagccatcatatcaggtgtagcga

SEQ ID NO: 51 - DNA, 51 bp, Homo sapiens
  misc_feature (26)...(0): 1 of 2 allelic variants (52 is other entry)
  misc_feature (0)...(0): Accession number cg39547655
gctggatccacagcgagcggaagtcacccttcttagcacgacggtcacgga

SEQ ID NO: 52 - DNA, 51 bp, Homo sapiens
  misc_feature (26)...(0): 2 of 2 allelic variants (51 is other entry)
  misc_feature (0)...(0): Accession number cg39547655
gctggatccacagcgagcggaagtcgcccttcttagcacgacggtcacgga

SEQ ID NO: 53 - DNA, 51 bp, Homo sapiens
  misc_feature (26)...(0): 1 of 2 allelic variants (54 is other entry)
  misc_feature (0)...(0): Accession number cg29358731
tctcgcctaggttggtcatgacatggcgaagctcagcagcggagatgaagc

SEQ ID NO: 54 - DNA, 51 bp, Homo sapiens
  misc_feature (26)...(0): 2 of 2 allelic variants (53 is other entry)
  misc_feature (0)...(0): Accession number cg29358731
tctcgcctaggttggtcatgacatgtcgaagctcagcagcggagatgaagc

SEQ ID NO: 55 - DNA, 51 bp, Homo sapiens
  misc_feature (26)...(0): 1 of 2 allelic variants (56 is other entry)
  misc_feature (0)...(0): Accession number cg29358731
tcatgacatggcgaagctcagcagcggagatgaagccgttctggtccttgt

SEQ ID NO: 56 - DNA, 51 bp, Homo sapiens
  misc_feature (26)...(0): 2 of 2 allelic variants (55 is other entry)
  misc_feature (0)...(0): Accession number cg29358731
tcatgacatggcgaagctcagcagcagagatgaagccgttctggtccttgt

SEQ ID NO: 57 - DNA, 51 bp, Homo sapiens
  misc_feature (26)...(0): 1 of 2 allelic variants (58 is other entry)
  misc_feature (0)...(0): Accession number cg29358731
agccgttctggtccttgtcgaacacacggaaggcctccttgagctcctcct

SEQ ID NO: 58 - DNA, 51 bp, Homo sapiens
  misc_feature (26)...(0): 2 of 2 allelic variants (57 is other entry)
  misc_feature (0)...(0): Accession number cg29358731
agccgttctggtccttgtcgaacacgcggaaggcctccttgagctcctcct

SEQ ID NO: 59 - DNA, 51 bp, Homo sapiens
  misc_feature (26)...(0): 1 of 2 allelic variants (60 is other entry)
  misc_feature (0)...(0): Accession number cg29358731
tgcgtgccatcaggttgagaaactcaggaaagtcgatggttccattgccat

SEQ ID NO: 60 - DNA, 51 bp, Homo sapiens
  misc_feature (26)...(0): 2 of 2 allelic variants (59 is other entry)
  misc_feature (0)...(0): Accession number cg29358731
tgcgtgccatcaggttgagaaactcgggaaagtcgatggttccattgccat

SEQ ID NO: 61 - DNA, 51 bp, Homo sapiens
  misc_feature (26)...(0): 1 of 2 allelic variants (62 is other entry)
  misc_feature (0)...(0): Accession number cg29358731
gtgccatcaggttgagaaactcaggaaagtcgatggttccattgccatcag

SEQ ID NO: 62 - DNA, 51 bp, Homo sapiens
  misc_feature (26)...(0): 2 of 2 allelic variants (61 is other entry)
  misc_feature (0)...(0): Accession number cg29358731
gtgccatcaggttgagaaactcagggaagtcgatggttccattgccatcag

SEQ ID NO: 63 - DNA, 51 bp, Homo sapiens
  misc_feature (26)...(0): 1 of 2 allelic variants (64 is other entry)
  misc_feature (0)...(0): Accession number cg44127439
tgctgcgaagaatctcgagggcctcctcgcgggtaatggactcccccctca

SEQ ID NO: 64 - DNA, 51 bp, Homo sapiens
  misc_feature (26)...(0): 2 of 2 allelic variants (63 is other entry)
  misc_feature (0)...(0): Accession number cg44127439
tgctgcgaagaatctcgagggcctcttcgcgggtaatggactcccccctca

SEQ ID NO: 65 - DNA, 51 bp, Homo sapiens
  misc_feature (26)...(0): 1 of 2 allelic variants (66 is other entry)
  misc_feature (0)...(0): Accession number cg44127439
agtccatgaggcagcaccaatgtggactacccccggaaatggtgtcgtcgt

SEQ ID NO: 66 - DNA, 51 bp, Homo sapiens
  misc_feature (26)...(0): 2 of 2 allelic variants (65 is other entry)
  misc_feature (0)...(0): Accession number cg44127439
agtccatgaggcagcaccaatgtgggctacccccggaaatggtgtcgtcgt

SEQ ID NO: 67 - DNA, 51 bp, Homo sapiens
  misc_feature (26)...(0): 1 of 2 allelic variants (68 is other entry)
  misc_feature (0)...(0): Accession number cg25321479
agaaagtgttggctcccagggtggagattcccccgtgagccaggagcaggg

SEQ ID NO: 68 - DNA, 51 bp, Homo sapiens
  misc_feature (26)...(0): 2 of 2 allelic variants (67 is other entry)
  misc_feature (0)...(0): Accession number cg25321479
agaaagtgttggctcccagggtggaaattcccccgtgagccaggagcaggg

SEQ ID NO: 69 - DNA, 51 bp, Homo sapiens
  misc_feature (26)...(0): 1 of 2 allelic variants (70 is other entry)
  misc_feature (0)...(0): Accession number cg25321479
ctcccagggtggagattcccccgtgagccaggagcagggcctggaagatga

SEQ ID NO: 70 - DNA, 51 bp, Homo sapiens
  misc_feature (26)...(0): 2 of 2 allelic variants (69 is other entry)
  misc_feature (0)...(0): Accession number cg25321479
ctcccagggtggagattcccccgtgggccaggagcagggcctggaagatga

SEQ ID NO: 71 - DNA, 51 bp, Homo sapiens
  misc_feature (26)...(0): 1 of 2 allelic variants (72 is other entry)
  misc_feature (0)...(0): Accession number cg25321479
gtttgaacagtgccgccccaactcccgttccggtggggtgcgaggacgatc

SEQ ID NO: 72 - DNA, 51 bp, Homo sapiens
  misc_feature (26)...(0): 2 of 2 allelic variants (71 is other entry)
  misc_feature (0)...(0): Accession number cg25321479
gtttgaacagtgccgccccaactcctgttccggtggggtgcgaggacgatc

SEQ ID NO: 73 - DNA, 51 bp, Homo sapiens
  misc_feature (26)...(0): 1 of 2 allelic variants (74 is other entry)
  misc_feature (0)...(0): Accession number cg25321479
atcccgtaacgctgggcagtttgatggccgagagcacaaaggtgaaagcgc

SEQ ID NO: 74 - DNA, 51 bp, Homo sapiens
  misc_feature (26)...(0): 2 of 2 allelic variants (73 is other entry)
  misc_feature (0)...(0): Accession number cg25321479
atcccgtaacgctgggcagtttgatagccgagagcacaaaggtgaaagcgc

SEQ ID NO: 75 - DNA, 51 bp, Homo sapiens
  misc_feature (26)...(0): 1 of 2 allelic variants (76 is other entry)
  misc_feature (0)...(0): Accession number cg25321479
gcccacgtagtttcttggtgagcttataaaaggcgtacccagcccacggtc

SEQ ID NO: 76 - DNA, 51 bp, Homo sapiens
  misc_feature (26)...(0): 2 of 2 allelic variants (75 is other entry)
  misc_feature (0)...(0): Accession number cg25321479
gcccacgtagtttcttggtgagcttgtaaaaggcgtacccagcccacggtc

SEQ ID NO: 77 - DNA, 51 bp, Homo sapiens
  misc_feature (26)...(0): 1 of 2 allelic variants (78 is other entry)
  misc_feature (0)...(0): Accession number cg25321479
cacgtagtttcttggtgagcttataaaaggcgtacccagcccacggtcccg

SEQ ID NO: 78 - DNA, 51 bp, Homo sapiens
  misc_feature (26)...(0): 2 of 2 allelic variants (77 is other entry)
  misc_feature (0)...(0): Accession number cg25321479
cacgtagtttcttggtgagcttatagaaggcgtacccagcccacggtcccg

SEQ ID NO: 79 - DNA, 51 bp, Homo sapiens
  misc_feature (26)...(0): 1 of 2 allelic variants (80 is other entry)
  misc_feature (0)...(0): Accession number cg25321479
gtcccgcgatagccatcgagaaagtgttggctcccagggtggagattcccc

SEQ ID NO: 80 - DNA, 51 bp, Homo sapiens
  misc_feature (26)...(0): 2 of 2 allelic variants (79 is other entry)
  misc_feature (0)...(0): Accession number cg25321479
gtcccgcgatagccatcgagaaagtattggctcccagggtggagattcccc

SEQ ID NO: 81 - DNA, 39 bp, Homo sapiens
  misc_feature (14)...(0): 1 of 2 allelic variants (82 is other entry)
  misc_feature (0)...(0): Accession number cg25321479
acgcgtcaggcccacgtagtttcttggtgagcttataaa

SEQ ID NO: 82 - DNA, 39 bp, Homo sapiens
  misc_feature (14)...(0): 2 of 2 allelic variants (81 is other entry)
  misc_feature (0)...(0): Accession number cg25321479
acgcgtcaggcccgcgtagtttcttggtgagcttataaa

SEQ ID NO: 83 - DNA, 42 bp, Homo sapiens
  misc_feature (17)...(0): 1 of 2 allelic variants (84 is other entry)
  misc_feature (0)...(0): Accession number cg25321479
acgcgtcaggcccacgtagtttcttggtgagcttataaaagg

SEQ ID NO: 84 - DNA, 42 bp, Homo sapiens
  misc_feature (17)...(0): 2 of 2 allelic variants (83 is other entry)
  misc_feature (0)...(0): Accession number cg25321479
acgcgtcaggcccacgaagtttcttggtgagcttataaaagg

SEQ ID NO: 85 - DNA, 51 bp, Homo sapiens
  misc_feature (26)...(0): 1 of 2 allelic variants (86 is other entry)
  misc_feature (0)...(0): Accession number cg39548335
cttctgtattctcgttgttaccggcggccttcctgggagtgctcattattc

SEQ ID NO: 86 - DNA, 51 bp, Homo sapiens
  misc_feature (26)...(0): 2 of 2 allelic variants (85 is other entry)
  misc_feature (0)...(0): Accession number cg39548335
cttctgtattctcgttgttaccggcagccttcctgggagtgctcattattc

SEQ ID NO: 87 - DNA, 51 bp, Homo sapiens
  misc_feature (26)...(0): 1 of 2 allelic variants (88 is other entry)
  misc_feature (0)...(0): Accession number cg43335190
gtagttcatatctatttacttttgcctacatacgattacatacacgattgg

SEQ ID NO: 88 - DNA, 51 bp, Homo sapiens
  misc_feature (26)...(0): 2 of 2 allelic variants (87 is other entry)
  misc_feature (0)...(0): Accession number cg43335190
gtagttcatatctatttacttttgcttacatacgattacatacacgattgg

SEQ ID NO: 89 - DNA, 51 bp, Homo sapiens
  misc_feature (26)...(0): 1 of 2 allelic variants (90 is other entry)
  misc_feature (0)...(0): Accession number cg43335190
aattctcggtttcatactttttaccttgatccttccactgtttttccctgt

SEQ ID NO: 90 - DNA, 51 bp, Homo sapiens
  misc_feature (26)...(0): 2 of 2 allelic variants (89 is other entry)
  misc_feature (0)...(0): Accession number cg43335190
aattctcggtttcatactttttaccctgatccttccactgtttttccctgt

SEQ ID NO: 91 - DNA, 51 bp, Homo sapiens
  misc_feature (26)...(0): 1 of 2 allelic variants (92 is other entry)
  misc_feature (0)...(0): Accession number cg43298420
ggtgaccgtggtctgaaagaaggctgggttgaactggtacagcttcaggac

SEQ ID NO: 92 - DNA, 51 bp, Homo sapiens
  misc_feature (26)...(0): 2 of 2 allelic variants (91 is other entry)
  misc_feature (0)...(0): Accession number cg43298420
ggtgaccgtggtctgaaagaaggcttggttgaactggtacagcttcaggac

SEQ ID NO: 93 - DNA, 51 bp, Homo sapiens
  misc_feature (26)...(0): 1 of 2 allelic variants (94 is other entry)
  misc_feature (0)...(0): Accession number cg44928880
actgaggttgggtttcagaccaagacactggattctcctagttaagataaa

SEQ ID NO: 94 - DNA, 51 bp, Homo sapiens
  misc_feature (26)...(0): 2 of 2 allelic variants (93 is other entry)
  misc_feature (0)...(0): Accession number cg44928880
actgaggttgggtttcagaccaagatactggattctcctagttaagataaa

SEQ ID NO: 95 - DNA, 51 bp, Homo sapiens
  misc_feature (26)...(0): 1 of 2 allelic variants (96 is other entry)
  misc_feature (0)...(0): Accession number cg39410689
atcaccaccaccgccaccaccatcacacggaagatgctcctgcacctaaga

SEQ ID NO: 96 - DNA, 51 bp, Homo sapiens
  misc_feature (26)...(0): 2 of 2 allelic variants (95 is other entry)
  misc_feature (0)...(0): Accession number cg39410689
atcaccaccaccgccaccaccatcatacggaagatgctcctgcacctaaga

SEQ ID NO: 97 - DNA, 51 bp, Homo sapiens
  misc_feature (26)...(0): 1 of 2 allelic variants (98 is other entry)
  misc_feature (0)...(0): Accession number cg20297086
tgcacgacaagtacccggagctgaatgaggagtcgccgttcgaccagatcg

SEQ ID NO: 98 - DNA, 51 bp, Homo sapiens
  misc_feature (26)...(0): 2 of 2 allelic variants (97 is other entry)
  misc_feature (0)...(0): Accession number cg20297086
tgcacgacaagtacccggagctgaacgaggagtcgccgttcgaccagatcg

SEQ ID NO: 99 - DNA, 51 bp, Homo sapiens
  misc_feature (26)...(0): 1 of 2 allelic variants (100 is other entry)
  misc_feature (0)...(0): Accession number cg20297086
aggagcgtcagcgcggcatcaccatctcgatcgcccacatcgagtaccaga

SEQ ID NO: 100 - DNA, 51 bp, Homo sapiens
  misc_feature (26)...(0): 2 of 2 allelic variants (99 is other entry)
  misc_feature (0)...(0): Accession number cg20297086
aggagcgtcagcgcggcatcaccatttcgatcgcccacatcgagtaccaga

SEQ ID NO: 101 - DNA, 51 bp, Homo sapiens
  misc_feature (26)...(0): 1 of 2 allelic variants (102 is other entry)
  misc_feature (0)...(0): Accession number cg20297086
agcgcggcatcaccatctcgatcgcccacatcgagtaccagaccgagaagc

SEQ ID NO: 102 - DNA, 51 bp, Homo sapiens
  misc_feature (26)...(0): 2 of 2 allelic variants (101 is other entry)
  misc_feature (0)...(0): Accession number cg20297086
agcgcggcatcaccatctcgatcgctcacatcgagtaccagaccgagaagc

SEQ ID NO: 103 - DNA, 51 bp, Homo sapiens
  misc_feature (26)...(0): 1 of 2 allelic variants (104 is other entry)
  misc_feature (0)...(0): Accession number cg39386301
tatgttaatggtgaagaaattcacctccgaccgtggtatgtcaatgtgaga

SEQ ID NO: 104 - DNA, 51 bp, Homo sapiens
  misc_feature (26)...(0): 2 of 2 allelic variants (103 is other entry)
  misc_feature (0)...(0): Accession number cg39386301
tatgttaatggtgaagaaattcacccccgaccgtggtatgtcaatgtgaga

SEQ ID NO: 105 - DNA, 51 bp, Homo sapiens
  misc_feature (26)...(0): 1 of 2 allelic variants (106 is other entry)
  misc_feature (0)...(0): Accession number cg39386301
ataatgataaaatagttcgttcatatactccggtgggatcattgcagaaat

SEQ ID NO: 106 - DNA, 51 bp, Homo sapiens
  misc_feature (26)...(0): 2 of 2 allelic variants (105 is other entry)
  misc_feature (0)...(0): Accession number cg39386301
ataatgataaaatagttcgttcatacactccggtgggatcattgcagaaat

SEQ ID NO: 107 - DNA, 51 bp, Homo sapiens
  misc_feature (26)...(0): 1 of 2 allelic variants (108 is other entry)
  misc_feature (0)...(0): Accession number cg39515238
tcaagatctatattgcacaccagagctgttgttttatactacaactcatct

SEQ ID NO: 108 - DNA, 51 bp, Homo sapiens
  misc_feature (26)...(0): 2 of 2 allelic variants (107 is other entry)
  misc_feature (0)...(0): Accession number cg39515238
tcaagatctatattgcacaccagagatgttgttttatactacaactcatct

SEQ ID NO: 109 - DNA, 51 bp, Homo sapiens
  misc_feature (26)...(0): 1 of 2 allelic variants (110 is other entry)
  misc_feature (0)...(0): Accession number cg29693502
cagcggggtagcgcacctgatcgacgtattccaacagctcattcgtcaact

SEQ ID NO: 110 - DNA, 51 bp, Homo sapiens
  misc_feature (26)...(0): 2 of 2 allelic variants (109 is other entry)
  misc_feature (0)...(0): Accession number cg29693502
cagcggggtagcgcacctgatcgacatattccaacagctcattcgtcaact

SEQ ID NO: 111 - DNA, 51 bp, Homo sapiens
  misc_feature (26)...(0): 1 of 2 allelic variants (112 is other entry)
  misc_feature (0)...(0): Accession number cg29693502
tcaactcccggtcgccggcaccgtgactagcccgcagcagggcctgggatt

SEQ ID NO: 112 - DNA, 51 bp, Homo sapiens
  misc_feature (26)...(0): 2 of 2 allelic variants (111 is other entry)
  misc_feature (0)...(0): Accession number cg29693502
tcaactcccggtcgccggcaccgtggctagcccgcagcagggcctgggatt

SEQ ID NO: 113 - DNA, 51 bp, Homo sapiens
  misc_feature (26)...(0): 1 of 2 allelic variants (114 is other entry)
  misc_feature (0)...(0): Accession number cg29693502
ccaggctccgtaccatcggaccggatcggccttccgggcgcagatcggcat

SEQ ID NO: 114 - DNA, 51 bp, Homo sapiens
  misc_feature (26)...(0): 2 of 2 allelic variants (113 is other entry)
  misc_feature (0)...(0): Accession number cg29693502
ccaggctccgtaccatcggaccggaccggccttccgggcgcagatcggcat

SEQ ID NO: 115 - DNA, 51 bp, Homo sapiens
  misc_feature (26)...(0): 1 of 2 allelic variants (116 is other entry)
  misc_feature (0)...(0): Accession number cg29693502
ggtccgcgccgtgtttgccgagcaggttgcgtagcttagtgacgattttca

SEQ ID NO: 116 - DNA, 51 bp, Homo sapiens
  misc_feature (26)...(0): 2 of 2 allelic variants (115 is other entry)
  misc_feature (0)...(0): Accession number cg29693502
ggtccgcgccgtgtttgccgagcagattgcgtagcttagtgacgattttca

SEQ ID NO: 117 - DNA, 51 bp, Homo sapiens
  misc_feature (26)...(0): 1 of 2 allelic variants (118 is other entry)
  misc_feature (0)...(0): Accession number cg29693502
ccgcgccgtgtttgccgagcaggttgcgtagcttagtgacgattttcagcg

SEQ ID NO: 118 - DNA, 51 bp, Homo sapiens
  misc_feature (26)...(0): 2 of 2 allelic variants (117 is other entry)
  misc_feature (0)...(0): Accession number cg29693502
ccgcgccgtgtttgccgagcaggttacgtagcttagtgacgattttcagcg

SEQ ID NO: 119 - DNA, 51 bp, Homo sapiens
  misc_feature (26)...(0): 1 of 2 allelic variants (120 is other entry)
  misc_feature (0)...(0): Accession number cg29693502
gtttgccgagcaggttgcgtagcttagtgacgattttcagcgccttctccc

SEQ ID NO: 120 - DNA, 51 bp, Homo sapiens
  misc_feature (26)...(0): 2 of 2 allelic variants (119 is other entry)
  misc_feature (0)...(0): Accession number cg29693502
gtttgccgagcaggttgcgtagcttggtgacgattttcagcgccttctccc

SEQ ID NO: 121 - DNA, 51 bp, Homo sapiens
  misc_feature (26)...(0): 1 of 2 allelic variants (122 is other entry)
  misc_feature (0)...(0): Accession number cg29693502
cgagcaggttgcgtagcttagtgacgattttcagcgccttctccccgactc

SEQ ID NO: 122 - DNA, 51 bp, Homo sapiens
  misc_feature (26)...(0): 2 of 2 allelic variants (121 is other entry)
  misc_feature (0)...(0): Accession number cg29693502
cgagcaggttgcgtagcttagtgacaattttcagcgccttctccccgactc

SEQ ID NO: 123 - DNA, 51 bp, Homo sapiens
  misc_feature (26)...(0): 1 of 2 allelic variants (124 is other entry)
  misc_feature (0)...(0): Accession number cg43935044
gagtctggggctggctgggcttctggctgtcctctgtcgccggatgggctc

SEQ ID NO: 124 - DNA, 51 bp, Homo sapiens
  misc_feature (26)...(0): 2 of 2 allelic variants (123 is other entry)
  misc_feature (0)...(0): Accession number cg43935044
gagtctggggctggctgggcttctgtctgtcctctgtcgccggatgggctc

SEQ ID NO: 125 - DNA, 51 bp, Homo sapiens
  misc_feature (26)...(0): 1 of 2 allelic variants (126 is other entry)
  misc_feature (0)...(0): Accession number cg27850036
tgaatggtggcagaccggcgtaggtgtctagccagtccatgtcaccgtaga

SEQ ID NO: 126 - DNA, 51 bp, Homo sapiens
  misc_feature (26)...(0): 2 of 2 allelic variants (125 is other entry)
  misc_feature (0)...(0): Accession number cg27850036
tgaatggtggcagaccggcgtaggtatctagccagtccatgtcaccgtaga

SEQ ID NO: 127 - DNA, 39 bp, Homo sapiens
  misc_feature (14)...(0): 1 of 2 allelic variants (128 is other entry)
  misc_feature (0)...(0): Accession number cg27850036
acgcgttggactctttagcggtggagaatccggcgtact

SEQ ID NO: 128 - DNA, 39 bp, Homo sapiens
  misc_feature (14)...(0): 2 of 2 allelic variants (127 is other entry)
  misc_feature (0)...(0): Accession number cg27850036
acgcgttggactccttagcggtggagaatccggcgtact

SEQ ID NO: 129 - DNA, 51 bp, Homo sapiens
  misc_feature (26)...(0): 1 of 2 allelic variants (130 is other entry)
  misc_feature (0)...(0): Accession number cg27850036
tagcggtggagaatccggcgtactggcgaatcgtccacggccggaaggcat

SEQ ID NO: 130 - DNA, 51 bp, Homo sapiens
  misc_feature (26)...(0): 2 of 2 allelic variants (129 is other entry)
  misc_feature (0)...(0): Accession number cg27850036
tagcggtggagaatccggcgtactgacgaatcgtccacggccggaaggcat

SEQ ID NO: 131 - DNA, 51 bp, Homo sapiens
  misc_feature (26)...(0): 1 of 2 allelic variants (132 is other entry)
  misc_feature (0)...(0): Accession number cg42331882
tgtgcgtagggaaagtcagtgtcgtgcagctcccaggagcctcctgagcgt

SEQ ID NO: 132 - DNA, 51 bp, Homo sapiens
  misc_feature (26)...(0): 2 of 2 allelic variants (131 is other entry)
  misc_feature (0)...(0): Accession number cg42331882
tgtgcgtagggaaagtcagtgtcgtacagctcccaggagcctcctgagcgt

SEQ ID NO: 133 - DNA, 51 bp, Homo sapiens
  misc_feature (26)...(0): 1 of 2 allelic variants (134 is other entry)
  misc_feature (0)...(0): Accession number cg43945926
acaacgcgagccaggagtactacacagcgctcatcaacgtgacggtgcagg

SEQ ID NO: 134 - DNA, 51 bp, Homo sapiens
  misc_feature (26)...(0): 2 of 2 allelic variants (133 is other entry)
  misc_feature (0)...(0): Accession number cg43945926
acaacgcgagccaggagtactacacggcgctcatcaacgtgacggtgcagg

SEQ ID NO: 135 - DNA, 37 bp, Homo sapiens
  misc_feature (12)...(0): 1 of 2 allelic variants (136 is other entry)
  misc_feature (0)...(0): Accession number cg39575634
agatctgggacaatgtctggggaagtgccacccaaca

SEQ ID NO: 136 - DNA, 37 bp, Homo sapiens
  misc_feature (12)...(0): 2 of 2 allelic variants (135 is other entry)
  misc_feature (0)...(0): Accession number cg39575634
agatctgggacgatgtctggggaagtgccacccaaca

SEQ ID NO: 137 - DNA, 51 bp, Homo sapiens
  misc_feature (26)...(0): 1 of 2 allelic variants (138 is other entry)
  misc_feature (0)...(0): Accession number cg39575634
tcttcacggttactgatcccagaaacatccttttaacgaacgaacagctag

SEQ ID NO: 138 - DNA, 51 bp, Homo sapiens
  misc_feature (26)...(0): 2 of 2 allelic variants (137 is other entry)
  misc_feature (0)...(0): Accession number cg39575634
tcttcacggttactgatcccagaaatatccttttaacgaacgaacagctag

SEQ ID NO: 139 - DNA, 51 bp, Homo sapiens
  misc_feature (26)...(0): 1 of 2 allelic variants (140 is other entry)
  misc_feature (0)...(0): Accession number cg39575634
agctagagaatgcgaggaaagtggtacacgattacaggcaaggaatcgttc

SEQ ID NO: 140 - DNA, 51 bp, Homo sapiens
  misc_feature (26)...(0): 2 of 2 allelic variants (139 is other entry)
  misc_feature (0)...(0): Accession number cg39575634
agctagagaatgcgaggaaagtggtgcacgattacaggcaaggaatcgttc

SEQ ID NO: 141 - DNA, 47 bp, Homo sapiens
  misc_feature (26)...(0): 1 of 2 allelic variants (142 is other entry)
  misc_feature (0)...(0): Accession number cg39575634
tcctgccggcctcacggaaaatgagttatggagagcgaagtacgcgt

SEQ ID NO: 142 - DNA, 47 bp, Homo sapiens
  misc_feature (26)...(0): 2 of 2 allelic variants (141 is other entry)
  misc_feature (0)...(0): Accession number cg39575634
tcctgccggcctcacggaaaatgagctatggagagcgaagtacgcgt

SEQ ID NO: 143 - DNA, 51 bp, Homo sapiens
  misc_feature (26)...(0): 1 of 2 allelic variants (144 is other entry)
  misc_feature (0)...(0): Accession number cg27826036
gtagggcgacggcgtatttatgtccctcgccaagcacgacagcgttagaca

SEQ ID NO: 144 - DNA, 51 bp, Homo sapiens
  misc_feature (26)...(0): 2 of 2 allelic variants (143 is other entry)
  misc_feature (0)...(0): Accession number cg27826036
gtagggcgacggcgtatttatgtccttcgccaagcacgacagcgttagaca

SEQ ID NO: 145 - DNA, 51 bp, Homo sapiens
  misc_feature (26)...(0): 1 of 2 allelic variants (146 is other entry)
  misc_feature (0)...(0): Accession number cg27826036
tagacaggtacgggcagttggccatgagagtggcctcgaccttctgtgggg

SEQ ID NO: 146 - DNA, 51 bp, Homo sapiens
  misc_feature (26)...(0): 2 of 2 allelic variants (145 is other entry)
  misc_feature (0)...(0): Accession number cg27826036
tagacaggtacgggcagttggccatcagagtggcctcgaccttctgtgggg

SEQ ID NO: 147 - DNA, 51 bp, Homo sapiens
  misc_feature (26)...(0): 1 of 2 allelic variants (148 is other entry)
  misc_feature (0)...(0): Accession number cg42538578
agagacattgccctccactgctgacgcaattgtaatgatcagatctgtggc

SEQ ID NO: 148 - DNA, 51 bp, Homo sapiens
  misc_feature (26)...(0): 2 of 2 allelic variants (147 is other entry)
  misc_feature (0)...(0): Accession number cg42538578
agagacattgccctccactgctgacacaattgtaatgatcagatctgtggc

SEQ ID NO: 149 - DNA, 51 bp, Homo sapiens
  misc_feature (26)...(0): 1 of 2 allelic variants (150 is other entry)
  misc_feature (0)...(0): Accession number cg42538578
ggatttcaggaactggggagaggctggctcctttggaggctgagctgacag

SEQ ID NO: 150 - DNA, 51 bp, Homo sapiens
  misc_feature (26)...(0): 2 of 2 allelic variants (149 is other entry)
  misc_feature (0)...(0): Accession number cg42538578
ggatttcaggaactggggagaggctagctcctttggaggctgagctgacag

SEQ ID NO: 151 - DNA, 51 bp, Homo sapiens
  misc_feature (26)...(0): 1 of 2 allelic variants (152 is other entry)
  misc_feature (0)...(0): Accession number cg44002673
agcaagctctttgaaacctgagcccacgcagaccagaagtaaacaggcacc

SEQ ID NO: 152 - DNA, 51 bp, Homo sapiens
  misc_feature (26)...(0): 2 of 2 allelic variants (151 is other entry)
  misc_feature (0)...(0): Accession number cg44002673
agcaagctctttgaaacctgagcccgcgcagaccagaagtaaacaggcacc

SEQ ID NO: 153 - DNA, 51 bp, Homo sapiens
  misc_feature (26)...(0): 1 of 2 allelic variants (154 is other entry)
  misc_feature (0)...(0): Accession number cg39710199
agccggtgcggcctgaggtgcggggcggagatcgagtgtcgtcatgtcaat

SEQ ID NO: 154 - DNA, 51 bp, Homo sapiens
  misc_feature (26)...(0): 2 of 2 allelic variants (153 is other entry)
  misc_feature (0)...(0): Accession number cg39710199
agccggtgcggcctgaggtgcggggtggagatcgagtgtcgtcatgtcaat

SEQ ID NO: 155 - DNA, 51 bp, Homo sapiens
  misc_feature (26)...(0): 1 of 2 allelic variants (156 is other entry)
  misc_feature (0)...(0): Accession number cg39710199
tgtgggtagtgagcacgacggagaccccgtcatgacgcatttgctcaacga

SEQ ID NO: 156 - DNA, 51 bp, Homo sapiens
  misc_feature (26)...(0): 2 of 2 allelic variants (155 is other entry)
  misc_feature (0)...(0): Accession number cg39710199
tgtgggtagtgagcacgacggagacaccgtcatgacgcatttgctcaacga

SEQ ID NO: 157 - DNA, 51 bp, Homo sapiens
  misc_feature (26)...(0): 1 of 2 allelic variants (158 is other entry)
  misc_feature (0)...(0): Accession number cg38821538
atcacctgaggtccggagttcaagatcagcctggccaacatgatgaaaccc

SEQ ID NO: 158 - DNA, 51 bp, Homo sapiens
  misc_feature (26)...(0): 2 of 2 allelic variants (157 is other entry)
  misc_feature (0)...(0): Accession number cg38821538
atcacctgaggtccggagttcaagaccagcctggccaacatgatgaaaccc

SEQ ID NO: 159 - DNA, 51 bp, Homo sapiens
  misc_feature (26)...(0): 1 of 2 allelic variants (160 is other entry)
  misc_feature (0)...(0): Accession number cg21632104
cgtcgcagtacgttctggcctgtcaacgttttgcatatcccggcaaaggcc

SEQ ID NO: 160 - DNA, 51 bp, Homo sapiens
  misc_feature (26)...(0): 2 of 2 allelic variants (159 is other entry)
  misc_feature (0)...(0): Accession number cg21632104
cgtcgcagtacgttctggcctgtcagcgttttgcatatcccggcaaaggcc

SEQ ID NO: 161 - DNA, 51 bp, Homo sapiens
  misc_feature (26)...(0): 1 of 2 allelic variants (162 is other entry)
  misc_feature (0)...(0): Accession number cg20370177
cccaagccaataccaagatgatcgcaactggcatcatgtctcccatgcctt

SEQ ID NO: 162 - DNA, 51 bp, Homo sapiens
  misc_feature (26)...(0): 2 of 2 allelic variants (161 is other entry)
  misc_feature (0)...(0): Accession number cg20370177
cccaagccaataccaagatgatcgccactggcatcatgtctcccatgcctt

SEQ ID NO: 163 - DNA, 51 bp, Homo sapiens
  misc_feature (26)...(0): 1 of 2 allelic variants (164 is other entry)
  misc_feature (0)...(0): Accession number cg14810223
cgagcagcccgccaggactctggctactggagatgggcgcccggctatcgc

SEQ ID NO: 164 - DNA, 51 bp, Homo sapiens
  misc_feature (26)...(0): 2 of 2 allelic variants (163 is other entry)
  misc_feature (0)...(0): Accession number cg14810223
cgagcagcccgccaggactctggctgctggagatgggcgcccggctatcgc

SEQ ID NO: 165 - DNA, 51 bp, Homo sapiens
  misc_feature (26)...(0): 1 of 2 allelic variants (166 is other entry)
  misc_feature (0)...(0): Accession number cg19882105
gagatcagtgtgatgatgcacaggacggatgcgggaatcccagctcttcat

SEQ ID NO: 166 - DNA, 51 bp, Homo sapiens
  misc_feature (26)...(0): 2 of 2 allelic variants (165 is other entry)
  misc_feature (0)...(0): Accession number cg19882105
gagatcagtgtgatgatgcacaggatggatgcgggaatcccagctcttcat

SEQ ID NO: 167 - DNA, 51 bp, Homo sapiens
  misc_feature (26)...(0): 1 of 2 allelic variants (168 is other entry)
  misc_feature (0)...(0): Accession number cg19882105
agtgtgatgatgcacaggacggatgcgggaatcccagctcttcatatggct

SEQ ID NO: 168 - DNA, 51 bp, Homo sapiens
  misc_feature (26)...(0): 2 of 2 allelic variants (167 is other entry)
  misc_feature (0)...(0): Accession number cg19882105
agtgtgatgatgcacaggacggatgtgggaatcccagctcttcatatggct

SEQ ID NO: 169 - DNA, 51 bp, Homo sapiens
  misc_feature (26)...(0): 1 of 2 allelic variants (170 is other entry)
  misc_feature (0)...(0): Accession number cg19885950
tcctcaagtctttgttcaaatatcagcttttcagcaagaccttcattaact

SEQ ID NO: 170 - DNA, 51 bp, Homo sapiens
  misc_feature (26)...(0): 2 of 2 allelic variants (169 is other entry)
  misc_feature (0)...(0): Accession number cg19885950
tcctcaagtctttgttcaaatatcatcttttcagcaagaccttcattaact

SEQ ID NO: 171 - DNA, 51 bp, Homo sapiens
  misc_feature (26)...(0): 1 of 2 allelic variants (172 is other entry)
  misc_feature (0)...(0): Accession number cg20452710
tggcctggagagaggcgggagggacactggcctggagagaggcgggaggga

SEQ ID NO: 172 - DNA, 51 bp, Homo sapiens
  misc_feature (26)...(0): 2 of 2 allelic variants (171 is other entry)
  misc_feature (0)...(0): Accession number cg20452710
tggcctggagagaggcgggagggacgctggcctggagagaggcgggaggga

SEQ ID NO: 173 - DNA, 51 bp, Homo sapiens
  misc_feature (26)...(0): 1 of 2 allelic variants (174 is other entry)
  misc_feature (0)...(0): Accession number cg20452710
gacaggggagagaggcgggagggacactggcctggagagaggcgggaggga

SEQ ID NO: 174 - DNA, 51 bp, Homo sapiens
  misc_feature (26)...(0): 2 of 2 allelic variants (173 is other entry)
  misc_feature (0)...(0): Accession number cg20452710
gacaggggagagaggcgggagggacgctggcctggagagaggcgggaggga

SEQ ID NO: 175 - DNA, 51 bp, Homo sapiens
  misc_feature (26)...(0): 1 of 2 allelic variants (176 is other entry)
  misc_feature (0)...(0): Accession number cg20454325
acatccctgcactgtcaccagcccgaccccttgtaccatggcagggttggg

SEQ ID NO: 176 - DNA, 51 bp, Homo sapiens
  misc_feature (26)...(0): 2 of 2 allelic variants (175 is other entry)
  misc_feature (0)...(0): Accession number cg20454325
acatccctgcactgtcaccagcccggccccttgtaccatggcagggttggg

SEQ ID NO: 177 - DNA, 51 bp, Homo sapiens
  misc_feature (26)...(0): 1 of 2 allelic variants (178 is other entry)
  misc_feature (0)...(0): Accession number cg20454325
tgcactgtcaccagcccgaccccttgtaccatggcagggttgggctgactg

SEQ ID NO: 178 - DNA, 51 bp, Homo sapiens
  misc_feature (26)...(0): 2 of 2 allelic variants (177 is other entry)
  misc_feature (0)...(0): Accession number cg20454325
tgcactgtcaccagcccgaccccttataccatggcagggttgggctgactg

SEQ ID NO: 179 - DNA, 51 bp, Homo sapiens
  misc_feature (26)...(0): 1 of 2 allelic variants (180 is other entry)
  misc_feature (0)...(0): Accession number cg20595730
ctccaaagacttgattccaagaaacatctgtgaaattcactaagtttaaga

SEQ ID NO: 180 - DNA, 51 bp, Homo sapiens
  misc_feature (26)...(0): 2 of 2 allelic variants (179 is other entry)
  misc_feature (0)...(0): Accession number cg20595730
ctccaaagacttgattccaagaaacgtctgtgaaattcactaagtttaaga

SEQ ID NO: 181 - DNA, 51 bp, Homo sapiens
  misc_feature (26)...(0): 1 of 2 allelic variants (182 is other entry)
  misc_feature (0)...(0): Accession number cg20595730
aacatctgtgaaattcactaagtttaagatatgaagagacagactagttat

SEQ ID NO: 182 - DNA, 51 bp, Homo sapiens
  misc_feature (26)...(0): 2 of 2 allelic variants (181 is other entry)
  misc_feature (0)...(0): Accession number cg20595730
aacatctgtgaaattcactaagtttcagatatgaagagacagactagttat

SEQ ID NO: 183 - DNA, 51 bp, Homo sapiens
  misc_feature (26)...(0): 1 of 2 allelic variants (184 is other entry)
  misc_feature (0)...(0): Accession number cg20610793
gggccgacccgagcagatgtgtcgtcatcgaggactccgctttcggattgc

SEQ ID NO: 184 - DNA, 51 bp, Homo sapiens
  misc_feature (26)...(0): 2 of 2 allelic variants (183 is other entry)
  misc_feature (0)...(0): Accession number cg20610793
gggccgacccgagcagatgtgtcgttatcgaggactccgctttcggattgc

SEQ ID NO: 185 - DNA, 51 bp, Homo sapiens
  misc_feature (26)...(0): 1 of 2 allelic variants (186 is other entry)
  misc_feature (0)...(0): Accession number cg20610793
cgagcagatgtgtcgtcatcgaggactccgctttcggattgcgtgccggac

SEQ ID NO: 186 - DNA, 51 bp, Homo sapiens
  misc_feature (26)...(0): 2 of 2 allelic variants (185 is other entry)
  misc_feature (0)...(0): Accession number cg20610793
cgagcagatgtgtcgtcatcgaggattccgctttcggattgcgtgccggac

SEQ ID NO: 187 - DNA, 51 bp, Homo sapiens
  misc_feature (26)...(0): 1 of 2 allelic variants (188 is other entry)
  misc_feature (0)...(0): Accession number cg20610793
tcggattgcgtgccggacgggctgccggagcgtgggttctcacggtcggac

SEQ ID NO: 188 - DNA, 51 bp, Homo sapiens
  misc_feature (26)...(0): 2 of 2 allelic variants (187 is other entry)
  misc_feature (0)...(0): Accession number cg20610793
tcggattgcgtgccggacgggctgctggagcgtgggttctcacggtcggac

SEQ ID NO: 189 - DNA, 51 bp, Homo sapiens
  misc_feature (26)...(0): 1 of 2 allelic variants (190 is other entry)
  misc_feature (0)...(0): Accession number cg20610793
cgtgggttctcacggtcggacgcaggctcaagggccagggggacatgtggg

SEQ ID NO: 190 - DNA, 51 bp, Homo sapiens
  misc_feature (26)...(0): 2 of 2 allelic variants (189 is other entry)
  misc_feature (0)...(0): Accession number cg20610793
cgtgggttctcacggtcggacgcagactcaagggccagggggacatgtggg

SEQ ID NO: 191 - DNA, 51 bp, Homo sapiens
  misc_feature (26)...(0): 1 of 2 allelic variants (192 is other entry)
  misc_feature (0)...(0): Accession number cg20610793
tcacggtcggacgcaggctcaagggccagggggacatgtgggttcccgggc

SEQ ID NO: 192 - DNA, 51 bp, Homo sapiens
  misc_feature (26)...(0): 2 of 2 allelic variants (191 is other entry)
  misc_feature (0)...(0): Accession number cg20610793
tcacggtcggacgcaggctcaagggacagggggacatgtgggttcccgggc

SEQ ID NO: 193 - DNA, 51 bp, Homo sapiens
  misc_feature (26)...(0): 1 of 2 allelic variants (194 is other entry)
  misc_feature (0)...(0): Accession number cg20610793
gggacatgtgggttcccgggctggatgatgagcgggtgaccttctgggaac

SEQ ID NO: 194 - DNA, 51 bp, Homo sapiens
  misc_feature (26)...(0): 2 of 2 allelic variants (193 is other entry)
  misc_feature (0)...(0): Accession number cg20610793
gggacatgtgggttcccgggctggacgatgagcgggtgaccttctgggaac

SEQ ID NO: 195 - DNA, 51 bp, Homo sapiens
  misc_feature (26)...(0): 1 of 2 allelic variants (196 is other entry)
  misc_feature (0)...(0): Accession number cg20610793
gggctggatgatgagcgggtgaccttctgggaaccccatcgatgagggcgt

SEQ ID NO: 196 - DNA, 51 bp, Homo sapiens
  misc_feature (26)...(0): 2 of 2 allelic variants (195 is other entry)
  misc_feature (0)...(0): Accession number cg20610793
gggctggatgatgagcgggtgacctcctgggaaccccatcgatgagggcgt

SEQ ID NO: 197 - DNA, 51 bp, Homo sapiens
  misc_feature (26)...(0): 1 of 2 allelic variants (198 is other entry)
  misc_feature (0)...(0): Accession number cg20610793
gagcgggtgaccttctgggaaccccatcgatgagggcgtgcgagctgacac

SEQ ID NO: 198 - DNA, 51 bp, Homo sapiens
  misc_feature (26)...(0): 2 of 2 allelic variants (197 is other entry)
  misc_feature (0)...(0): Accession number cg20610793
gagcgggtgaccttctgggaaccccgtcgatgagggcgtgcgagctgacac

SEQ ID NO: 199 - DNA, 51 bp, Homo sapiens
  misc_feature (26)...(0): 1 of 2 allelic variants (200 is other entry)
  misc_feature (0)...(0): Accession number cg20610793
cggattggcctcacaaggctggctgaaactgttcgacaccgtccttggggt

SEQ ID NO: 200 - DNA, 51 bp, Homo sapiens
  misc_feature (26)...(0): 2 of 2 allelic variants (199 is other entry)
  misc_feature (0)...(0): Accession number cg20610793
cggattggcctcacaaggctggctggaactgttcgacaccgtccttggggt

SEQ ID NO: 201 - DNA, 51 bp, Homo sapiens
  misc_feature (26)...(0): 1 of 2 allelic variants (202 is other entry)
  misc_feature (0)...(0): Accession number cg20711459
cccgactgaaggcacggatgagttcaccgatcccatatttggagtggagag

SEQ ID NO: 202 - DNA, 51 bp, Homo sapiens
  misc_feature (26)...(0): 2 of 2 allelic variants (201 is other entry)
  misc_feature (0)...(0): Accession number cg20711459
cccgactgaaggcacggatgagttcgccgatcccatatttggagtggagag

SEQ ID NO: 203 - DNA, 51 bp, Homo sapiens
  misc_feature (26)...(0): 1 of 2 allelic variants (204 is other entry)
  misc_feature (0)...(0): Accession number cg20723460
ttccccggcgaagaaaaaggcgtcgcccattcctcttccaaaacgctacaa

SEQ ID NO: 204 - DNA, 51 bp, Homo sapiens
  misc_feature (26)...(0): 2 of 2 allelic variants (203 is other entry)
  misc_feature (0)...(0): Accession number cg20723460
ttccccggcgaagaaaaaggcgtcgtccattcctcttccaaaacgctacaa

SEQ ID NO: 205 - DNA, 51 bp, Homo sapiens
  misc_feature (26)...(0): 1 of 2 allelic variants (206 is other entry)
  misc_feature (0)...(0): Accession number cg20723460
ctacaacaaaaaccaccacgcttcccttccttcttccttgcccctttccct

SEQ ID NO: 206 - DNA, 51 bp, Homo sapiens
  misc_feature (26)...(0): 2 of 2 allelic variants (205 is other entry)
  misc_feature (0)...(0): Accession number cg20723460
ctacaacaaaaaccaccacgcttcctttccttcttccttgcccctttccct

SEQ ID NO: 207 - DNA, 51 bp, Homo sapiens
  misc_feature (26)...(0): 1 of 2 allelic variants (208 is other entry)
  misc_feature (0)...(0): Accession number cg20724182
gatcattgtaggctatttcaaaaccgccaaacaagccatgaacgcagcaaa

SEQ ID NO: 208 - DNA, 51 bp, Homo sapiens
  misc_feature (26)...(0): 2 of 2 allelic variants (207 is other entry)
  misc_feature (0)...(0): Accession number cg20724182
gatcattgtaggctatttcaaaaccaccaaacaagccatgaacgcagcaaa

SEQ ID NO: 209 - DNA, 51 bp, Homo sapiens
  misc_feature (26)...(0): 1 of 2 allelic variants (210 is other entry)
  misc_feature (0)...(0): Accession number cg20724182
tatttcaaaaccgccaaacaagccatgaacgcagcaaaacaattccactgg

SEQ ID NO: 210 - DNA, 51 bp, Homo sapiens
  misc_feature (26)...(0): 2 of 2 allelic variants (209 is other entry)
  misc_feature (0)...(0): Accession number cg20724182
tatttcaaaaccgccaaacaagccacgaacgcagcaaaacaattccactgg

SEQ ID NO: 211 - DNA, 51 bp, Homo sapiens
  misc_feature (26)...(0): 1 of 2 allelic variants (212 is other entry)
  misc_feature (0)...(0): Accession number cg20724182
tgctgggggcgcttcacagacaacatcaaatacgctgtagctgcccaatat

SEQ ID NO: 212 - DNA, 51 bp, Homo sapiens
  misc_feature (26)...(0): 2 of 2 allelic variants (211 is other entry)
  misc_feature (0)...(0): Accession number cg20724182
tgctgggggcgcttcacagacaacaacaaatacgctgtagctgcccaatat

SEQ ID NO: 213 - DNA, 51 bp, Homo sapiens
  misc_feature (26)...(0): 1 of 2 allelic variants (214 is other entry)
  misc_feature (0)...(0): Accession number cg20724182
gggggcgcttcacagacaacatcaaatacgctgtagctgcccaatattgga

SEQ ID NO: 214 - DNA, 51 bp, Homo sapiens
  misc_feature (26)...(0): 2 of 2 allelic variants (213 is other entry)
  misc_feature (0)...(0): Accession number cg20724182
gggggcgcttcacagacaacatcaagtacgctgtagctgcccaatattgga

SEQ ID NO: 215 - DNA, 51 bp, Homo sapiens
  misc_feature (26)...(0): 1 of 2 allelic variants (216 is other entry)
  misc_feature (0)...(0): Accession number cg20724478
actatctgggagttggggccctgcacggcactggaaccaaacctgaggctg

SEQ ID NO: 216 - DNA, 51 bp, Homo sapiens
  misc_feature (26)...(0): 2 of 2 allelic variants (215 is other entry)
  misc_feature (0)...(0): Accession number cg20724478
actatctgggagttggggccctgcatggcactggaaccaaacctgaggctg

SEQ ID NO: 217 - DNA, 51 bp, Homo sapiens
  misc_feature (26)...(0): 1 of 2 allelic variants (218 is other entry)
  misc_feature (0)...(0): Accession number cg20724478
atctgggagttggggccctgcacggcactggaaccaaacctgaggctgggg

SEQ ID NO: 218 - DNA, 51 bp, Homo sapiens
  misc_feature (26)...(0): 2 of 2 allelic variants (217 is other entry)
  misc_feature (0)...(0): Accession number cg20724478
atctgggagttggggccctgcacggtactggaaccaaacctgaggctgggg

SEQ ID NO: 219 - DNA, 51 bp, Homo sapiens
  misc_feature (26)...(0): 1 of 2 allelic variants (220 is other entry)
  misc_feature (0)...(0): Accession number cg20724478
gggagctcggcctggctgggatacgcgatgtcgtcaacgccagcccgtggc

SEQ ID NO: 220 - DNA, 51 bp, Homo sapiens
  misc_feature (26)...(0): 2 of 2 allelic variants (219 is other entry)
  misc_feature (0)...(0): Accession number cg20724478
gggagctcggcctggctgggatacgtgatgtcgtcaacgccagcccgtggc

SEQ ID NO: 221 - DNA, 51 bp, Homo sapiens
  misc_feature (26)...(0): 1 of 2 allelic variants (222 is other entry)
  misc_feature (0)...(0): Accession number cg20724478
gttgccgaaattggggccgatggtgcccatgttgggcagtctgacatgccg

SEQ ID NO: 222 - DNA, 51 bp, Homo sapiens
  misc_feature (26)...(0): 2 of 2 allelic variants (221 is other entry)
  misc_feature (0)...(0): Accession number cg20724478
gttgccgaaattggggccgatggtgtccatgttgggcagtctgacatgccg

SEQ ID NO: 223 - DNA, 51 bp, Homo sapiens
  misc_feature (26)...(0): 1 of 2 allelic variants (224 is other entry)
  misc_feature (0)...(0): Accession number cg20726641
tcaagaaatttgccattcttgaccacgacctgaccgaggattctcactcag

SEQ ID NO: 224 - DNA, 51 bp, Homo sapiens
  misc_feature (26)...(0): 2 of 2 allelic variants (223 is other entry)
  misc_feature (0)...(0): Accession number cg20726641
tcaagaaatttgccattcttgaccatgacctgaccgaggattctcactcag

SEQ ID NO: 225 - DNA, 51 bp, Homo sapiens
  misc_feature (26)...(0): 1 of 2 allelic variants (226 is other entry)
  misc_feature (0)...(0): Accession number cg20726641
ttgaccacgacctgaccgaggattctcactcagtgacgaccagtctcaagg

SEQ ID NO: 226 - DNA, 51 bp, Homo sapiens
  misc_feature (26)...(0): 2 of 2 allelic variants (225 is other entry)
  misc_feature (0)...(0): Accession number cg20726641
ttgaccacgacctgaccgaggattcacactcagtgacgaccagtctcaagg

SEQ ID NO: 227 - DNA, 51 bp, Homo sapiens
  misc_feature (26)...(0): 1 of 2 allelic variants (228 is other entry)
  misc_feature (0)...(0): Accession number cg20726641
ctgacgaaaacgatcaaccgggcgcttcaaagggaagcgacgcttcatgac

SEQ ID NO: 228 - DNA, 51 bp, Homo sapiens
  misc_feature (26)...(0): 2 of 2 allelic variants (227 is other entry)
  misc_feature (0)...(0): Accession number cg20726641
ctgacgaaaacgatcaaccgggcgcctcaaagggaagcgacgcttcatgac

SEQ ID NO: 229 - DNA, 51 bp, Homo sapiens
  misc_feature (26)...(0): 1 of 2 allelic variants (230 is other entry)
  misc_feature (0)...(0): Accession number cg20726641
ctgtcgtcgtcgatattccactgcgctggtccgatatggatgcgcagggac

SEQ ID NO: 230 - DNA, 51 bp, Homo sapiens
  misc_feature (26)...(0): 2 of 2 allelic variants (229 is other entry)
  misc_feature (0)...(0): Accession number cg20726641
ctgtcgtcgtcgatattccactgcgttggtccgatatggatgcgcagggac

SEQ ID NO: 231 - DNA, 51 bp, Homo sapiens
  misc_feature (26)...(0): 1 of 2 allelic variants (232 is other entry)
  misc_feature (0)...(0): Accession number cg20726641
ggtccgatatggatgcgcagggacatgttaataacgttcgtattagcgagc

SEQ ID NO: 232 - DNA, 51 bp, Homo sapiens
  misc_feature (26)...(0): 2 of 2 allelic variants (231 is other entry)
  misc_feature (0)...(0): Accession number cg20726641
ggtccgatatggatgcgcagggacacgttaataacgttcgtattagcgagc

SEQ ID NO: 233 - DNA, 51 bp, Homo sapiens
  misc_feature (26)...(0): 1 of 2 allelic variants (234 is other entry)
  misc_feature (0)...(0): Accession number cg20726641
ccgatatggatgcgcagggacatgttaataacgttcgtattagcgagctcg

SEQ ID NO: 234 - DNA, 51 bp, Homo sapiens
  misc_feature (26)...(0): 2 of 2 allelic variants (233 is other entry)
  misc_feature (0)...(0): Accession number cg20726641
ccgatatggatgcgcagggacatgtcaataacgttcgtattagcgagctcg

SEQ ID NO: 235 - DNA, 49 bp, Homo sapiens
  misc_feature (26)...(0): 1 of 2 allelic variants (236 is other entry)
  misc_feature (0)...(0): Accession number cg20726641
tggatgcgcagggacatgttaataacgttcgtattagcgagctcgaaca

SEQ ID NO: 236 - DNA, 49 bp, Homo sapiens
  misc_feature (26)...(0): 2 of 2 allelic variants (235 is other entry)
  misc_feature (0)...(0): Accession number cg20726641
tggatgcgcagggacatgttaataatgttcgtattagcgagctcgaaca

SEQ ID NO: 237 - DNA, 51 bp, Homo sapiens
  misc_feature (26)...(0): 1 of 2 allelic variants (238 is other entry)
  misc_feature (0)...(0): Accession number cg20728487
ggaaactcatcggcaatatcgttgctgcttgggagactggcttcatgctgg

SEQ ID NO: 238 - DNA, 51 bp, Homo sapiens
  misc_feature (26)...(0): 2 of 2 allelic variants (237 is other entry)
  misc_feature (0)...(0): Accession number cg20728487
ggaaactcatcggcaatatcgttgccgcttgggagactggcttcatgctgg

SEQ ID NO: 239 - DNA, 48 bp, Homo sapiens
  misc_feature (23)...(0): 1 of 2 allelic variants (240 is other entry)
  misc_feature (0)...(0): Accession number cg20730743
acgcgtactggcggatctcagtacgataacccaccagattgccggtga

SEQ ID NO: 240 - DNA, 48 bp, Homo sapiens
  misc_feature (23)...(0): 2 of 2 allelic variants (239 is other entry)
  misc_feature (0)...(0): Accession number cg20730743
acgcgtactggcggatctcagtgcgataacccaccagattgccggtga

SEQ ID NO: 241 - DNA, 51 bp, Homo sapiens
  misc_feature (26)...(0): 1 of 2 allelic variants (242 is other entry)
  misc_feature (0)...(0): Accession number cg20730743
acgcgtactggcggatctcagtacgataacccaccagattgccggtgaact

SEQ ID NO: 242 - DNA, 51 bp, Homo sapiens
  misc_feature (26)...(0): 2 of 2 allelic variants (241 is other entry)
  misc_feature (0)...(0): Accession number cg20730743
acgcgtactggcggatctcagtacggtaacccaccagattgccggtgaact

SEQ ID NO: 243 - DNA, 51 bp, Homo sapiens
  misc_feature (26)...(0): 1 of 2 allelic variants (244 is other entry)
  misc_feature (0)...(0): Accession number cg20730743
gctgtccggccccaccggcgagtttatcgagctgggagggatcgattttcc

SEQ ID NO: 244 - DNA, 51 bp, Homo sapiens
  misc_feature (26)...(0): 2 of 2 allelic variants (243 is other entry)
  misc_feature (0)...(0): Accession number cg20730743
gctgtccggccccaccggcgagtttgtcgagctgggagggatcgattttcc

SEQ ID NO: 245 - DNA, 51 bp, Homo sapiens
  misc_feature (26)...(0): 1 of 2 allelic variants (246 is other entry)
  misc_feature (0)...(0): Accession number cg20744814
ggcacccgggtgctgctggccatggccacccacgaagctctccctgccccc

SEQ ID NO: 246 - DNA, 50 bp, Homo sapiens
  misc_feature (26)...(0): 2 of 2 allelic variants (245 is other entry)
  misc_feature (25)...(26): nucleotide deleted between bases 25 and 26
  misc_feature (0)...(0): Accession number cg20744814
ggcacccgggtgctgctggccatggcacccacgaagctctccctgccccc

SEQ ID NO: 247 - DNA, 51 bp, Homo sapiens
  misc_feature (26)...(0): 1 of 2 allelic variants (248 is other entry)
  misc_feature (0)...(0): Accession number cg21147609
gttccatgcctttctagaccccaggccctttcctgcatgattttatcagca

SEQ ID NO: 248 - DNA, 51 bp, Homo sapiens
  misc_feature (26)...(0): 2 of 2 allelic variants (247 is other entry)
  misc_feature (0)...(0): Accession number cg21147609
gttccatgcctttctagaccccaggtcctttcctgcatgattttatcagca

SEQ ID NO: 249 - DNA, 51 bp, Homo sapiens
  misc_feature (26)...(0): 1 of 2 allelic variants (250 is other entry)
  misc_feature (0)...(0): Accession number cg21147791
aataaagtgtttccttgagtcctgtgagttgctctagcaaatttatcaatc

SEQ ID NO: 250 - DNA, 51 bp, Homo sapiens
  misc_feature (26)...(0): 2 of 2 allelic variants (249 is other entry)
  misc_feature (0)...(0): Accession number cg21147791
aataaagtgtttccttgagtcctgtaagttgctctagcaaatttatcaatc

SEQ ID NO: 251 - DNA, 51 bp, Homo sapiens
  misc_feature (26)...(0): 1 of 2 allelic variants (252 is other entry)
  misc_feature (0)...(0): Accession number cg21148047
atggtgattcctcaagaaattagaaacagaattaccctatgatccagcatt

SEQ ID NO: 252 - DNA, 51 bp, Homo sapiens
  misc_feature (26)...(0): 2 of 2 allelic variants (251 is other entry)
  misc_feature (0)...(0): Accession number cg21148047
atggtgattcctcaagaaattagaagcagaattaccctatgatccagcatt

SEQ ID NO: 253 - DNA, 51 bp, Homo sapiens
  misc_feature (26)...(0): 1 of 2 allelic variants (254 is other entry)
  misc_feature (0)...(0): Accession number cg21148203
tatgtttgctgggggagtgggtgggttgcagaacttaagaccaggacaatt

SEQ ID NO: 254 - DNA, 51 bp, Homo sapiens
  misc_feature (26)...(0): 2 of 2 allelic variants (253 is other entry)
  misc_feature (0)...(0): Accession number cg21148203
tatgtttgctgggggagtgggtgggctgcagaacttaagaccaggacaatt

SEQ ID NO: 255 - DNA, 51 bp, Homo sapiens
  misc_feature (26)...(0): 1 of 2 allelic variants (256 is other entry)
  misc_feature (0)...(0): Accession number cg21150589
cctttgaaattcgatttccttccccaggtgaaagaggagaacagattctac

SEQ ID NO: 256 - DNA, 51 bp, Homo sapiens
  misc_feature (26)...(0): 2 of 2 allelic variants (255 is other entry)
  misc_feature (0)...(0): Accession number cg21150589
cctttgaaattcgatttccttccccgggtgaaagaggagaacagattctac

SEQ ID NO: 257 - DNA, 51 bp, Homo sapiens
  misc_feature (26)...(0): 1 of 2 allelic variants (258 is other entry)
  misc_feature (0)...(0): Accession number cg21395558
attgacagagtgacatttgggcaacgcgtgaaggaagtgggtggaggaggt

SEQ ID NO: 258 - DNA, 51 bp, Homo sapiens
  misc_feature (26)...(0): 2 of 2 allelic variants (257 is other entry)
  misc_feature (0)...(0): Accession number cg21395558
attgacagagtgacatttgggcaactcgtgaaggaagtgggtggaggaggt

SEQ ID NO: 259 - DNA, 51 bp, Homo sapiens
  misc_feature (26)...(0): 1 of 2 allelic variants (260 is other entry)
  misc_feature (0)...(0): Accession number cg21395558
tgacagagtgacatttgggcaacgcgtgaaggaagtgggtggaggaggtgg

SEQ ID NO: 260 - DNA, 51 bp, Homo sapiens
  misc_feature (26)...(0): 2 of 2 allelic variants (259 is other entry)
  misc_feature (0)...(0): Accession number cg21395558
tgacagagtgacatttgggcaacgcttgaaggaagtgggtggaggaggtgg

SEQ ID NO: 261 - DNA, 51 bp, Homo sapiens
  misc_feature (26)...(0): 1 of 2 allelic variants (262 is other entry)
  misc_feature (0)...(0): Accession number cg21395558
gtgacatttgggcaacgcgtgaaggaagtgggtggaggaggtggcagccag

SEQ ID NO: 262 - DNA, 51 bp, Homo sapiens
  misc_feature (26)...(0): 2 of 2 allelic variants (261 is other entry)
  misc_feature (0)...(0): Accession number cg21395558
gtgacatttgggcaacgcgtgaagggagtgggtggaggaggtggcagccag

SEQ ID NO: 263 - DNA, 51 bp, Homo sapiens
  misc_feature (26)...(0): 1 of 2 allelic variants (264 is other entry)
  misc_feature (0)...(0): Accession number cg21415668
aggactggtcagggaggagttagggcaggaggactggtcagggaggagtta

SEQ ID NO: 264 - DNA, 51 bp, Homo sapiens
  misc_feature (26)...(0): 2 of 2 allelic variants (263 is other entry)
  misc_feature (0)...(0): Accession number cg21415668
aggactggtcagggaggagttaggggaggaggactggtcagggaggagtta

SEQ ID NO: 265 - DNA, 51 bp, Homo sapiens
  misc_feature (26)...(0): 1 of 2 allelic variants (266 is other entry)
  misc_feature (0)...(0): Accession number cg21417734
caacgggttaccccggcgcacctggctttgcccgatcacagcggcacgcat

SEQ ID NO: 266 - DNA, 51 bp, Homo sapiens
  misc_feature (26)...(0): 2 of 2 allelic variants (265 is other entry)
  misc_feature (0)...(0): Accession number cg21417734
caacgggttaccccggcgcacctgggtttgcccgatcacagcggcacgcat

SEQ ID NO: 267 - DNA, 51 bp, Homo sapiens
  misc_feature (26)...(0): 1 of 2 allelic variants (268 is other entry)
  misc_feature (0)...(0): Accession number cg21428517
ccatgcccatcccggtgccgcagaaaaagattcctcgatcggcttttccgt

SEQ ID NO: 268 - DNA, 51 bp, Homo sapiens
  misc_feature (26)...(0): 2 of 2 allelic variants (267 is other entry)
  misc_feature (0)...(0): Accession number cg21428517
ccatgcccatcccggtgccgcagaagaagattcctcgatcggcttttccgt

SEQ ID NO: 269 - DNA, 51 bp, Homo sapiens
  misc_feature (26)...(0): 1 of 2 allelic variants (270 is other entry)
  misc_feature (0)...(0): Accession number cg21428762
tggtcgtggtctcatcagaggtgaaaacgatgagcggggtgctcggacgca

SEQ ID NO: 270 - DNA, 51 bp, Homo sapiens
  misc_feature (26)...(0): 2 of 2 allelic variants (269 is other entry)
  misc_feature (0)...(0): Accession number cg21428762
tggtcgtggtctcatcagaggtgaagacgatgagcggggtgctcggacgca

SEQ ID NO: 271 - DNA, 51 bp, Homo sapiens
  misc_feature (26)...(0): 1 of 2 allelic variants (272 is other entry)
  misc_feature (0)...(0): Accession number cg21428762
gggtgctcggacgcagacgagcgatacgacgggcggtgtcaccggacttgg

SEQ ID NO: 272 - DNA, 51 bp, Homo sapiens
  misc_feature (26)...(0): 2 of 2 allelic variants (271 is other entry)
  misc_feature (0)...(0): Accession number cg21428762
gggtgctcggacgcagacgagcgatgcgacgggcggtgtcaccggacttgg

SEQ ID NO: 273 - DNA, 51 bp, Homo sapiens
  misc_feature (26)...(0): 1 of 2 allelic variants (274 is other entry)
  misc_feature (0)...(0): Accession number cg21428762
acaccggggtaacgacggcgtgagcgccccagacccaggcgagggtcttgg

SEQ ID NO: 274 - DNA, 51 bp, Homo sapiens
  misc_feature (26)...(0): 2 of 2 allelic variants (273 is other entry)
  misc_feature (0)...(0): Accession number cg21428762
acaccggggtaacgacggcgtgagcaccccagacccaggcgagggtcttgg

SEQ ID NO: 275 - DNA, 51 bp, Homo sapiens
  misc_feature (26)...(0): 1 of 2 allelic variants (276 is other entry)
  misc_feature (0)...(0): Accession number cg21429119
ttggtaggccaaggcaggacgaccacttgagcctgggaatttgaaaccagc

SEQ ID NO: 276 - DNA, 51 bp, Homo sapiens
  misc_feature (26)...(0): 2 of 2 allelic variants (275 is other entry)
  misc_feature (0)...(0): Accession number cg21429119
ttggtaggccaaggcaggacgaccatttgagcctgggaatttgaaaccagc

SEQ ID NO: 277 - DNA, 51 bp, Homo sapiens
  misc_feature (26)...(0): 1 of 2 allelic variants (278 is other entry)
  misc_feature (0)...(0): Accession number cg21429119
aatttgaaaccagcctgggcaacatagtgagtctttgtttctacaagaaat

SEQ ID NO: 278 - DNA, 51 bp, Homo sapiens
  misc_feature (26)...(0): 2 of 2 allelic variants (277 is other entry)
  misc_feature (0)...(0): Accession number cg21429119
aatttgaaaccagcctgggcaacatggtgagtctttgtttctacaagaaat

SEQ ID NO: 279 - DNA, 51 bp, Homo sapiens
  misc_feature (26)...(0): 1 of 2 allelic variants (280 is other entry)
  misc_feature (0)...(0): Accession number cg21429119
tgggcaacatagtgagtctttgtttctacaagaaatttaaaaaaaaaatta

SEQ ID NO: 280 - DNA, 51 bp, Homo sapiens
  misc_feature (26)...(0): 2 of 2 allelic variants (279 is other entry)
  misc_feature (0)...(0): Accession number cg21429119
tgggcaacatagtgagtctttgtttttacaagaaatttaaaaaaaaaatta

SEQ ID NO: 281 - DNA, 51 bp, Homo sapiens
  misc_feature (26)...(0): 1 of 2 allelic variants (282 is other entry)
  misc_feature (0)...(0): Accession number cg21429803
tgcacccggcgtgccctgaaacacacgcgtgtgccccgaaatacctgcatt

SEQ ID NO: 282 - DNA, 51 bp, Homo sapiens
  misc_feature (26)...(0): 2 of 2 allelic variants (281 is other entry)
  misc_feature (0)...(0): Accession number cg21429803
tgcacccggcgtgccctgaaacacatgcgtgtgccccgaaatacctgcatt

SEQ ID NO: 283 - DNA, 51 bp, Homo sapiens
  misc_feature (26)...(0): 1 of 2 allelic variants (284 is other entry)
  misc_feature (0)...(0): Accession number cg21433543
ggtggatctggtcgggatcggtgaccactctggtcatcgtcgattatgcga

SEQ ID NO: 284 - DNA, 51 bp, Homo sapiens
  misc_feature (26)...(0): 2 of 2 allelic variants (283 is other entry)
  misc_feature (0)...(0): Accession number cg21433543
ggtggatctggtcgggatcggtgactactctggtcatcgtcgattatgcga

SEQ ID NO: 285 - DNA, 51 bp, Homo sapiens
  misc_feature (26)...(0): 1 of 2 allelic variants (286 is other entry)
  misc_feature (0)...(0): Accession number cg21433543
catcgtcgattatgcgacgaccttcctaccactgaagttatggcgtcgctg

SEQ ID NO: 286 - DNA, 51 bp, Homo sapiens
  misc_feature (26)...(0): 2 of 2 allelic variants (285 is other entry)
  misc_feature (0)...(0): Accession number cg21433543
catcgtcgattatgcgacgaccttcttaccactgaagttatggcgtcgctg

SEQ ID NO: 287 - DNA, 51 bp, Homo sapiens
  misc_feature (26)...(0): 1 of 2 allelic variants (288 is other entry)
  misc_feature (0)...(0): Accession number cg21433543
actgaagttatggcgtcgctgcgtagccgaggctggggtagcgctcctggg

SEQ ID NO: 288 - DNA, 50 bp, Homo sapiens
  misc_feature (26)...(0): 2 of 2 allelic variants (287 is other entry)
  misc_feature (25)...(26): nucleotide deleted between bases 25 and 26
  misc_feature (0)...(0): Accession number cg21433543
actgaagttatggcgtcgctgcgtaccgaggctggggtagcgctcctggg

SEQ ID NO: 289 - DNA, 51 bp, Homo sapiens
  misc_feature (26)...(0): 1 of 2 allelic variants (290 is other entry)
  misc_feature (0)...(0): Accession number cg21433543
agccgaggctggggtagcgctcctgggcggaatcgtcctgacgcggccgcc

SEQ ID NO: 290 - DNA, 51 bp, Homo sapiens
  misc_feature (26)...(0): 2 of 2 allelic variants (289 is other entry)
  misc_feature (0)...(0): Accession number cg21433543
agccgaggctggggtagcgctcctgagcggaatcgtcctgacgcggccgcc

SEQ ID NO: 291 - DNA, 51 bp, Homo sapiens
  misc_feature (26)...(0): 1 of 2 allelic variants (292 is other entry)
  misc_feature (0)...(0): Accession number cg21435199
aaatttttaaaataaattataaagagctcctcttacctagaaataattatt

SEQ ID NO: 292 - DNA, 51 bp, Homo sapiens
  misc_feature (26)...(0): 2 of 2 allelic variants (291 is other entry)
  misc_feature (0)...(0): Accession number cg21435199
aaatttttaaaataaattataaagaactcctcttacctagaaataattatt

SEQ ID NO: 293 - DNA, 51 bp, Homo sapiens
  misc_feature (26)...(0): 1 of 2 allelic variants (294 is other entry)
  misc_feature (0)...(0): Accession number cg21637172
cggttggccaagcctggcactcaaacgtccgcctaacctggggtctttatt

SEQ ID NO: 294 - DNA, 51 bp, Homo sapiens
  misc_feature (26)...(0): 2 of 2 allelic variants (293 is other entry)
  misc_feature (0)...(0): Accession number cg21637172
cggttggccaagcctggcactcaaatgtccgcctaacctggggtctttatt

SEQ ID NO: 295 - DNA, 51 bp, Homo sapiens
  misc_feature (26)...(0): 1 of 2 allelic variants (296 is other entry)
  misc_feature (0)...(0): Accession number cg21643872
ggttgagtgggacgccttctacgagaagcaccctgagcttgacctggaaag

SEQ ID NO: 296 - DNA, 51 bp, Homo sapiens
  misc_feature (26)...(0): 2 of 2 allelic variants (295 is other entry)
  misc_feature (0)...(0): Accession number cg21643872
ggttgagtgggacgccttctacgaggagcaccctgagcttgacctggaaag

SEQ ID NO: 297 - DNA, 51 bp, Homo sapiens
  misc_feature (26)...(0): 1 of 2 allelic variants (298 is other entry)
  misc_feature (0)...(0): Accession number cg21657573
aaaaaggttaaagatcagacagacagctgaccttactgccctcaatggcca

SEQ ID NO: 298 - DNA, 51 bp, Homo sapiens
  misc_feature (26)...(0): 2 of 2 allelic variants (297 is other entry)
  misc_feature (0)...(0): Accession number cg21657573
aaaaaggttaaagatcagacagacacctgaccttactgccctcaatggcca

SEQ ID NO: 299 - DNA, 51 bp, Homo sapiens
  misc_feature (26)...(0): 1 of 2 allelic variants (300 is other entry)
  misc_feature (0)...(0): Accession number cg21657879
ccagggaaaggcagtccccctcccccacagcagtcacgaacctcagaagcc

SEQ ID NO: 300 - DNA, 51 bp, Homo sapiens
  misc_feature (26)...(0): 2 of 2 allelic variants (299 is other entry)
  misc_feature (0)...(0): Accession number cg21657879
ccagggaaaggcagtccccctccccgacagcagtcacgaacctcagaagcc

SEQ ID NO: 301 - DNA, 51 bp, Homo sapiens
  misc_feature (26)...(0): 1 of 2 allelic variants (302 is other entry)
  misc_feature (0)...(0): Accession number cg21659205
ccaaacaatccagcttgctcccctcgaccactcagaacaaacgccctaagt

SEQ ID NO: 302 - DNA, 51 bp, Homo sapiens
  misc_feature (26)...(0): 2 of 2 allelic variants (301 is other entry)
  misc_feature (0)...(0): Accession number cg21659205
ccaaacaatccagcttgctcccctcaaccactcagaacaaacgccctaagt

SEQ ID NO: 303 - DNA, 51 bp, Homo sapiens
  misc_feature (26)...(0): 1 of 2 allelic variants (304 is other entry)
  misc_feature (0)...(0): Accession number cg21660634
ccacgtgacgaccggaacatcactgtgacgcttcactcgggcaaccggtcg

SEQ ID NO: 304 - DNA, 51 bp, Homo sapiens
  misc_feature (26)...(0): 2 of 2 allelic variants (303 is other entry)
  misc_feature (0)...(0): Accession number cg21660634
ccacgtgacgaccggaacatcactgcgacgcttcactcgggcaaccggtcg

SEQ ID NO: 305 - DNA, 51 bp, Homo sapiens
  misc_feature (26)...(0): 1 of 2 allelic variants (306 is other entry)
  misc_feature (0)...(0): Accession number cg21660634
gccacggctcggtgaatccgactcgcggggccaacacaacggcctcaccca

SEQ ID NO: 306 - DNA, 51 bp, Homo sapiens
  misc_feature (26)...(0): 2 of 2 allelic variants (305 is other entry)
  misc_feature (0)...(0): Accession number cg21660634
gccacggctcggtgaatccgactcgtggggccaacacaacggcctcaccca

SEQ ID NO: 307 - DNA, 51 bp, Homo sapiens
  misc_feature (26)...(0): 1 of 2 allelic variants (308 is other entry)
  misc_feature (0)...(0): Accession number cg21661814
cgccgaaatcggtgacgatggccttcgcgtggccaatgtggaggtagccgt

SEQ ID NO: 308 - DNA, 51 bp, Homo sapiens
  misc_feature (26)...(0): 2 of 2 allelic variants (307 is other entry)
  misc_feature (0)...(0): Accession number cg21661814
cgccgaaatcggtgacgatggccttggcgtggccaatgtggaggtagccgt

SEQ ID NO: 309 - DNA, 51 bp, Homo sapiens
  misc_feature (26)...(0): 1 of 2 allelic variants (310 is other entry)
  misc_feature (0)...(0): Accession number cg21661814
ggacgcgcccgccgtaggtgtcctgttggatgtccgcgcgaacaacctgat

SEQ ID NO: 310 - DNA, 51 bp, Homo sapiens
  misc_feature (26)...(0): 2 of 2 allelic variants (309 is other entry)
  misc_feature (0)...(0): Accession number cg21661814
ggacgcgcccgccgtaggtgtcctggtggatgtccgcgcgaacaacctgat

SEQ ID NO: 311 - DNA, 51 bp, Homo sapiens
  misc_feature (26)...(0): 1 of 2 allelic variants (312 is other entry)
  misc_feature (0)...(0): Accession number cg21661814
cgtggacaacgtgggccggggagtagcctaaccactcaatgtctgcaatga

SEQ ID NO: 312 - DNA, 51 bp, Homo sapiens
  misc_feature (26)...(0): 2 of 2 allelic variants (311 is other entry)
  misc_feature (0)...(0): Accession number cg21661814
cgtggacaacgtgggccggggagtaacctaaccactcaatgtctgcaatga

SEQ ID NO: 313 - DNA, 51 bp, Homo sapiens
  misc_feature (26)...(0): 1 of 2 allelic variants (314 is other entry)
  misc_feature (0)...(0): Accession number cg21661814
tagcctaaccactcaatgtctgcaatgatcgactcgacatactcggtttcc

SEQ ID NO: 314 - DNA, 51 bp, Homo sapiens
  misc_feature (26)...(0): 2 of 2 allelic variants (313 is other entry)
  misc_feature (0)...(0): Accession number cg21661814
tagcctaaccactcaatgtctgcaacgatcgactcgacatactcggtttcc

SEQ ID NO: 315 - DNA, 51 bp, Homo sapiens
  misc_feature (26)...(0): 1 of 2 allelic variants (316 is other entry)
  misc_feature (0)...(0): Accession number cg21661814
tttcctcggtgcctggattagtatcatcaagtctcaggttgcaggtgccgc

SEQ ID NO: 316 - DNA, 51 bp, Homo sapiens
  misc_feature (26)...(0): 2 of 2 allelic variants (315 is other entry)
  misc_feature (0)...(0): Accession number cg21661814
tttcctcggtgcctggattagtatcgtcaagtctcaggttgcaggtgccgc

SEQ ID NO: 317 - DNA, 51 bp, Homo sapiens
  misc_feature (26)...(0): 1 of 2 allelic variants (318 is other entry)
  misc_feature (0)...(0): Accession number cg24113982
gctcggctgctgcagaagtctccttccctcctttgtggctggtatatagaa

SEQ ID NO: 318 - DNA, 51 bp, Homo sapiens
  misc_feature (26)...(0): 2 of 2 allelic variants (317 is other entry)
  misc_feature (0)...(0): Accession number cg24113982
gctcggctgctgcagaagtctcctttcctcctttgtggctggtatatagaa

SEQ ID NO: 319 - DNA, 51 bp, Homo sapiens
  misc_feature (26)...(0): 1 of 2 allelic variants (320 is other entry)
  misc_feature (0)...(0): Accession number cg25268133
ggccgtcatcgcggtcacgactcccgtgatcaccatgatcgtgggcatgac

SEQ ID NO: 320 - DNA, 51 bp, Homo sapiens
  misc_feature (26)...(0): 2 of 2 allelic variants (319 is other entry)
  misc_feature (0)...(0): Accession number cg25268133
ggccgtcatcgcggtcacgactcccatgatcaccatgatcgtgggcatgac

SEQ ID NO: 321 - DNA, 51 bp, Homo sapiens
  misc_feature (26)...(0): 1 of 2 allelic variants (322 is other entry)
  misc_feature (0)...(0): Accession number cg25309388
tgagagggtaaagtgccagtctgtgctaaaagaacgtgaaaaggaaaccta

SEQ ID NO: 322 - DNA, 51 bp, Homo sapiens
  misc_feature (26)...(0): 2 of 2 allelic variants (321 is other entry)
  misc_feature (0)...(0): Accession number cg25309388
tgagagggtaaagtgccagtctgtgttaaaagaacgtgaaaaggaaaccta

SEQ ID NO: 323 - DNA, 51 bp, Homo sapiens
  misc_feature (26)...(0): 1 of 2 allelic variants (324 is other entry)
  misc_feature (0)...(0): Accession number cg25339094
ttgcccagaccaatgcgatgggtcgtctccgccaccatcgagaaacgagaa

SEQ ID NO: 324 - DNA, 51 bp, Homo sapiens
  misc_feature (26)...(0): 2 of 2 allelic variants (323 is other entry)
  misc_feature (0)...(0): Accession number cg25339094
ttgcccagaccaatgcgatgggtcgcctccgccaccatcgagaaacgagaa

SEQ ID NO: 325 - DNA, 51 bp, Homo sapiens
  misc_feature (26)...(0): 1 of 2 allelic variants (326 is other entry)
  misc_feature (0)...(0): Accession number cg25339094
tgcgagcctgcacaccaacaacccccagatcggcgagtcgacctctcatcg

SEQ ID NO: 326 - DNA, 51 bp, Homo sapiens
  misc_feature (26)...(0): 2 of 2 allelic variants (325 is other entry)
  misc_feature (0)...(0): Accession number cg25339094
tgcgagcctgcacaccaacaaccccaagatcggcgagtcgacctctcatcg

SEQ ID NO: 327 - DNA, 51 bp, Homo sapiens
  misc_feature (26)...(0): 1 of 2 allelic variants (328 is other entry)
  misc_feature (0)...(0): Accession number cg25339094
cctgcacaccaacaacccccagatcggcgagtcgacctctcatcgtgccag

SEQ ID NO: 328 - DNA, 51 bp, Homo sapiens
  misc_feature (26)...(0): 2 of 2 allelic variants (327 is other entry)
  misc_feature (0)...(0): Accession number cg25339094
cctgcacaccaacaacccccagatcagcgagtcgacctctcatcgtgccag

SEQ ID NO: 329 - DNA, 51 bp, Homo sapiens
  misc_feature (26)...(0): 1 of 2 allelic variants (330 is other entry)
  misc_feature (0)...(0): Accession number cg27778388
gtcccagggtgacgcgaggttggggactgagcaaccaggaatagaccttca

SEQ ID NO: 330 - DNA, 51 bp, Homo sapiens
  misc_feature (26)...(0): 2 of 2 allelic variants (329 is other entry)
  misc_feature (0)...(0): Accession number cg27778388
gtcccagggtgacgcgaggttgggggctgagcaaccaggaatagaccttca

SEQ ID NO: 331 - DNA, 51 bp, Homo sapiens
  misc_feature (26)...(0): 1 of 2 allelic variants (332 is other entry)
  misc_feature (0)...(0): Accession number cg27802892
atctaaccggttctagacagcttaaacaaacagatacagtgcccttttctc

SEQ ID NO: 332 - DNA, 51 bp, Homo sapiens
  misc_feature (26)...(0): 2 of 2 allelic variants (331 is other entry)
  misc_feature (0)...(0): Accession number cg27802892
atctaaccggttctagacagcttaagcaaacagatacagtgcccttttctc

SEQ ID NO: 333 - DNA, 51 bp, Homo sapiens
  misc_feature (26)...(0): 1 of 2 allelic variants (334 is other entry)
  misc_feature (0)...(0): Accession number cg27802892
ctaaccggttctagacagcttaaacaaacagatacagtgcccttttctcag

SEQ ID NO: 334 - DNA, 51 bp, Homo sapiens
  misc_feature (26)...(0): 2 of 2 allelic variants (333 is other entry)
  misc_feature (0)...(0): Accession number cg27802892
ctaaccggttctagacagcttaaaccaacagatacagtgcccttttctcag

SEQ ID NO: 335 - DNA, 51 bp, Homo sapiens
  misc_feature (26)...(0): 1 of 2 allelic variants (336 is other entry)
  misc_feature (0)...(0): Accession number cg27805688
aatcccgttgctgtcgtgatgtgaaaccagcaccagttctgctggccacgc

SEQ ID NO: 336 - DNA, 51 bp, Homo sapiens
  misc_feature (26)...(0): 2 of 2 allelic variants (335 is other entry)
  misc_feature (0)...(0): Accession number cg27805688
aatcccgttgctgtcgtgatgtgaagccagcaccagttctgctggccacgc

SEQ ID NO: 337 - DNA, 51 bp, Homo sapiens
  misc_feature (26)...(0): 1 of 2 allelic variants (338 is other entry)
  misc_feature (0)...(0): Accession number cg27825173
ggccaccgcgggcaccgcacggacaccccgacacacgagcacccacacccc

SEQ ID NO: 338 - DNA, 51 bp, Homo sapiens
  misc_feature (26)...(0): 2 of 2 allelic variants (337 is other entry)
  misc_feature (0)...(0): Accession number cg27825173
ggccaccgcgggcaccgcacggacatcccgacacacgagcacccacacccc

SEQ ID NO: 339 - DNA, 51 bp, Homo sapiens
  misc_feature (26)...(0): 1 of 2 allelic variants (340 is other entry)
  misc_feature (0)...(0): Accession number cg27827050
ccgatggcaagtgggacagcctggagggcttgctcacctgcgagcccggcc

SEQ ID NO: 340 - DNA, 51 bp, Homo sapiens
  misc_feature (26)...(0): 2 of 2 allelic variants (339 is other entry)
  misc_feature (0)...(0): Accession number cg27827050
ccgatggcaagtgggacagcctggaaggcttgctcacctgcgagcccggcc

SEQ ID NO: 341 - DNA, 51 bp, Homo sapiens
  misc_feature (26)...(0): 1 of 2 allelic variants (342 is other entry)
  misc_feature (0)...(0): Accession number cg27828294
gtacaaaaactagtagatgtgtgaatgcaataaaagtgctcagaaacacac

SEQ ID NO: 342 - DNA, 51 bp, Homo sapiens
  misc_feature (26)...(0): 2 of 2 allelic variants (341 is other entry)
  misc_feature (0)...(0): Accession number cg27828294
gtacaaaaactagtagatgtgtgaacgcaataaaagtgctcagaaacacac

SEQ ID NO: 343 - DNA, 50 bp, Homo sapiens
  misc_feature (25)...(0): 1 of 2 allelic variants (344 is other entry)
  misc_feature (0)...(0): Accession number cg27845127
acgcgtcctgaagccgccgacgcgacgagaacagcaggccagcagctcga

SEQ ID NO: 344 - DNA, 50 bp, Homo sapiens
  misc_feature (25)...(0): 2 of 2 allelic variants (343 is other entry)
  misc_feature (0)...(0): Accession number cg27845127
acgcgtcctgaagccgccgacgcggcgagaacagcaggccagcagctcga

SEQ ID NO: 345 - DNA, 51 bp, Homo sapiens
  misc_feature (26)...(0): 1 of 2 allelic variants (346 is other entry)
  misc_feature (0)...(0): Accession number cg27845127
tcagtggcagatagccagcggcgactgagcgtgcgccatgatgccgcgact

SEQ ID NO: 346 - DNA, 51 bp, Homo sapiens
  misc_feature (26)...(0): 2 of 2 allelic variants (345 is other entry)
  misc_feature (0)...(0): Accession number cg27845127
tcagtggcagatagccagcggcgaccgagcgtgcgccatgatgccgcgact

SEQ ID NO: 347 - DNA, 51 bp, Homo sapiens
  misc_feature (26)...(0): 1 of 2 allelic variants (348 is other entry)
  misc_feature (0)...(0): Accession number cg27845127
gcggcgactgagcgtgcgccatgatgccgcgactgacaccacctgcggtcc

SEQ ID NO: 348 - DNA, 51 bp, Homo sapiens
  misc_feature (26)...(0): 2 of 2 allelic variants (347 is other entry)
  misc_feature (0)...(0): Accession number cg27845127
gcggcgactgagcgtgcgccatgataccgcgactgacaccacctgcggtcc

SEQ ID NO: 349 - DNA, 51 bp, Homo sapiens
  misc_feature (26)...(0): 1 of 2 allelic variants (350 is other entry)
  misc_feature (0)...(0): Accession number cg27922064
caaaaatgctcatttagtttcctcaacacccccagactgaccttcaaaact

SEQ ID NO: 350 - DNA, 51 bp, Homo sapiens
  misc_feature (26)...(0): 2 of 2 allelic variants (349 is other entry)
  misc_feature (0)...(0): Accession number cg27922064
caaaaatgctcatttagtttcctcagcacccccagactgaccttcaaaact

SEQ ID NO: 351 - DNA, 36 bp, Homo sapiens
  misc_feature (11)...(0): 1 of 2 allelic variants (352 is other entry)
  misc_feature (0)...(0): Accession number cg27928117
gctagcagctctggccctgcagctgagcacaggcca

SEQ ID NO: 352 - DNA, 36 bp, Homo sapiens
  misc_feature (11)...(0): 2 of 2 allelic variants (351 is other entry)
  misc_feature (0)...(0): Accession number cg27928117
gctagcagctgtggccctgcagctgagcacaggcca

SEQ ID NO: 353 - DNA, 51 bp, Homo sapiens
  misc_feature (26)...(0): 1 of 2 allelic variants (354 is other entry)
  misc_feature (0)...(0): Accession number cg27928117
tattcagtagggaaaagggcaaggacctgaaaaaagtgtattaagaatcgt

SEQ ID NO: 354 - DNA, 51 bp, Homo sapiens
  misc_feature (26)...(0): 2 of 2 allelic variants (353 is other entry)
  misc_feature (0)...(0): Accession number cg27928117
tattcagtagggaaaagggcaaggatctgaaaaaagtgtattaagaatcgt

SEQ ID NO: 355 - DNA, 51 bp, Homo sapiens
  misc_feature (26)...(0): 1 of 2 allelic variants (356 is other entry)
  misc_feature (0)...(0): Accession number cg27929704
gtcactgggcctgatgccaccggaggctgagctactgggcaccttcggcca

SEQ ID NO: 356 - DNA, 50 bp, Homo sapiens
  misc_feature (26)...(0): 2 of 2 allelic variants (355 is other entry)
  misc_feature (25)...(26): nucleotide deleted between bases 25 and 26
  misc_feature (0)...(0): Accession number cg27929704
gtcactgggcctgatgccaccggagctgagctactgggcaccttcggcca

SEQ ID NO: 357 - DNA, 51 bp, Homo sapiens
  misc_feature (26)...(0): 1 of 2 allelic variants (358 is other entry)
  misc_feature (0)...(0): Accession number cg27956615
ttctccatgctcctagatggaaaacacagtcattctgatcactttctctct

SEQ ID NO: 358 - DNA, 51 bp, Homo sapiens
  misc_feature (26)...(0): 2 of 2 allelic variants (357 is other entry)
  misc_feature (0)...(0): Accession number cg27956615
ttctccatgctcctagatggaaaacgcagtcattctgatcactttctctct

SEQ ID NO: 359 - DNA, 51 bp, Homo sapiens
  misc_feature (26)...(0): 1 of 2 allelic variants (360 is other entry)
  misc_feature (0)...(0): Accession number cg27957329
ggagctatggttttcgccaagtcaactcactgattgtgggacgggtggtgg

SEQ ID NO: 360 - DNA, 51 bp, Homo sapiens
  misc_feature (26)...(0): 2 of 2 allelic variants (359 is other entry)
  misc_feature (0)...(0): Accession number cg27957329
ggagctatggttttcgccaagtcaattcactgattgtgggacgggtggtgg

SEQ ID NO: 361 - DNA, 51 bp, Homo sapiens
  misc_feature (26)...(0): 1 of 2 allelic variants (362 is other entry)
  misc_feature (0)...(0): Accession number cg27962799
tgctcctcccgcgtgcttccgccgccggtggcttggacccgtcggggctgg

SEQ ID NO: 362 - DNA, 51 bp, Homo sapiens
  misc_feature (26)...(0): 2 of 2 allelic variants (361 is other entry)
  misc_feature (0)...(0): Accession number cg27962799
tgctcctcccgcgtgcttccgccgctggtggcttggacccgtcggggctgg

SEQ ID NO: 363 - DNA, 51 bp, Homo sapiens
  misc_feature (26)...(0): 1 of 2 allelic variants (364 is other entry)
  misc_feature (0)...(0): Accession number cg28315794
ggtttaggaatgctagcttttgaaacttcattcaaaatgtctttgaagcca

SEQ ID NO: 364 - DNA, 51 bp, Homo sapiens
  misc_feature (26)...(0): 2 of 2 allelic variants (363 is other entry)
  misc_feature (0)...(0): Accession number cg28315794
ggtttaggaatgctagcttttgaaatttcattcaaaatgtctttgaagcca

SEQ ID NO: 365 - DNA, 51 bp, Homo sapiens
  misc_feature (26)...(0): 1 of 2 allelic variants (366 is other entry)
  misc_feature (0)...(0): Accession number cg28389525
tcgtgttagaaaactttcgacctggagtcacgaagcgtttgggagtggatg

SEQ ID NO: 366 - DNA, 51 bp, Homo sapiens
  misc_feature (26)...(0): 2 of 2 allelic variants (365 is other entry)
  misc_feature (0)...(0): Accession number cg28389525
tcgtgttagaaaactttcgacctggggtcacgaagcgtttgggagtggatg

SEQ ID NO: 367 - DNA, 51 bp, Homo sapiens
  misc_feature (26)...(0): 1 of 2 allelic variants (368 is other entry)
  misc_feature (0)...(0): Accession number cg28389525
gtttgggagtggatgcggaaagtgtacataaaaccaatccgcgaataatat

SEQ ID NO: 368 - DNA, 51 bp, Homo sapiens
  misc_feature (26)...(0): 2 of 2 allelic variants (367 is other entry)
  misc_feature (0)...(0): Accession number cg28389525
gtttgggagtggatgcggaaagtgtgcataaaaccaatccgcgaataatat

SEQ ID NO: 369 - DNA, 51 bp, Homo sapiens
  misc_feature (26)...(0): 1 of 2 allelic variants (370 is other entry)
  misc_feature (0)...(0): Accession number cg28389525
gaataatatacgccagcatttcgggtttcggtcaagaggggccgttccgaa

SEQ ID NO: 370 - DNA, 51 bp, Homo sapiens
  misc_feature (26)...(0): 2 of 2 allelic variants (369 is other entry)
  misc_feature (0)...(0): Accession number cg28389525
gaataatatacgccagcatttcgggcttcggtcaagaggggccgttccgaa

SEQ ID NO: 371 - DNA, 51 bp, Homo sapiens
  misc_feature (26)...(0): 1 of 2 allelic variants (372 is other entry)
  misc_feature (0)...(0): Accession number cg28389525
tcgttgagcatgcagacgtcgtgttagaaaactttcgacctggagtcacga

SEQ ID NO: 372 - DNA, 51 bp, Homo sapiens
  misc_feature (26)...(0): 2 of 2 allelic variants (371 is other entry)
  misc_feature (0)...(0): Accession number cg28389525
tcgttgagcatgcagacgtcgtgttggaaaactttcgacctggagtcacga

SEQ ID NO: 373 - DNA, 51 bp, Homo sapiens
  misc_feature (26)...(0): 1 of 2 allelic variants (374 is other entry)
  misc_feature (0)...(0): Accession number cg28397602
cctctctgcacggctgtgtgtgtgcatgtccatgcctgtccaggtcaggac

SEQ ID NO: 374 - DNA, 51 bp, Homo sapiens
  misc_feature (26)...(0): 2 of 2 allelic variants (373 is other entry)
  misc_feature (0)...(0): Accession number cg28397602
cctctctgcacggctgtgtgtgtgcgtgtccatgcctgtccaggtcaggac

SEQ ID NO: 375 - DNA, 51 bp, Homo sapiens
  misc_feature (26)...(0): 1 of 2 allelic variants (376 is other entry)
  misc_feature (0)...(0): Accession number cg28459036
gcgacgagggtacgaccgtcggtagccgtgtagatcatacgtcggggccgg

SEQ ID NO: 376 - DNA, 51 bp, Homo sapiens
  misc_feature (26)...(0): 2 of 2 allelic variants (375 is other entry)
  misc_feature (0)...(0): Accession number cg28459036
gcgacgagggtacgaccgtcggtagtcgtgtagatcatacgtcggggccgg

SEQ ID NO: 377 - DNA, 51 bp, Homo sapiens
  misc_feature (26)...(0): 1 of 2 allelic variants (378 is other entry)
  misc_feature (0)...(0): Accession number cg28459036
atacgtcggggccgggtgacgcgccagagggcttgctgttcggtggcggtc

SEQ ID NO: 378 - DNA, 51 bp, Homo sapiens
  misc_feature (26)...(0): 2 of 2 allelic variants (377 is other entry)
  misc_feature (0)...(0): Accession number cg28459036
atacgtcggggccgggtgacgcgccggagggcttgctgttcggtggcggtc

SEQ ID NO: 379 - DNA, 51 bp, Homo sapiens
  misc_feature (26)...(0): 1 of 2 allelic variants (380 is other entry)
  misc_feature (0)...(0): Accession number cg28459036
atcccgatccaaatccagctagaccgaccataatcgtcaatgcgatcacca

SEQ ID NO: 380 - DNA, 51 bp, Homo sapiens
  misc_feature (26)...(0): 2 of 2 allelic variants (379 is other entry)
  misc_feature (0)...(0): Accession number cg28459036
atcccgatccaaatccagctagaccaaccataatcgtcaatgcgatcacca

SEQ ID NO: 381 - DNA, 51 bp, Homo sapiens
  misc_feature (26)...(0): 1 of 2 allelic variants (382 is other entry)
  misc_feature (0)...(0): Accession number cg28459036
aggcggccaagtcagcgcaggaggccgcgacgagggtacgaccgtcggtag

SEQ ID NO: 382 - DNA, 51 bp, Homo sapiens
  misc_feature (26)...(0): 2 of 2 allelic variants (381 is other entry)
  misc_feature (0)...(0): Accession number cg28459036
aggcggccaagtcagcgcaggaggcggcgacgagggtacgaccgtcggtag

SEQ ID NO: 383 - DNA, 51 bp, Homo sapiens
  misc_feature (26)...(0): 1 of 2 allelic variants (384 is other entry)
  misc_feature (0)...(0): Accession number cg28473092
caccctcgagcatcgtcacctcgatgctaattagagccatgtgccgatgag

SEQ ID NO: 384 - DNA, 51 bp, Homo sapiens
  misc_feature (26)...(0): 2 of 2 allelic variants (383 is other entry)
  misc_feature (0)...(0): Accession number cg28473092
caccctcgagcatcgtcacctcgatactaattagagccatgtgccgatgag

SEQ ID NO: 385 - DNA, 51 bp, Homo sapiens
  misc_feature (26)...(0): 1 of 2 allelic variants (386 is other entry)
  misc_feature (0)...(0): Accession number cg28473092
ggggtgcgccataccaactcccgacacaggacaccctcgcggaagtcgatc

SEQ ID NO: 386 - DNA, 51 bp, Homo sapiens
  misc_feature (26)...(0): 2 of 2 allelic variants (385 is other entry)
  misc_feature (0)...(0): Accession number cg28473092
ggggtgcgccataccaactcccgacgcaggacaccctcgcggaagtcgatc

SEQ ID NO: 387 - DNA, 51 bp, Homo sapiens
  misc_feature (26)...(0): 1 of 2 allelic variants (388 is other entry)
  misc_feature (0)...(0): Accession number cg28486260
tattatttgctattacccaagctgtaggggctgtccatttttatgcgaagt

SEQ ID NO: 388 - DNA, 51 bp, Homo sapiens
  misc_feature (26)...(0): 2 of 2 allelic variants (387 is other entry)
  misc_feature (0)...(0): Accession number cg28486260
tattatttgctattacccaagctgtgggggctgtccatttttatgcgaagt

SEQ ID NO: 389 - DNA, 51 bp, Homo sapiens
  misc_feature (26)...(0): 1 of 2 allelic variants (390 is other entry)
  misc_feature (0)...(0): Accession number cg29195033
gtgcaggctaatccacgacatgtattgacttccgtcgcggatcttgccgcc

SEQ ID NO: 390 - DNA, 51 bp, Homo sapiens
  misc_feature (26)...(0): 2 of 2 allelic variants (389 is other entry)
  misc_feature (0)...(0): Accession number cg29195033
gtgcaggctaatccacgacatgtatcgacttccgtcgcggatcttgccgcc

SEQ ID NO: 391 - DNA, 51 bp, Homo sapiens
  misc_feature (26)...(0): 1 of 2 allelic variants (392 is other entry)
  misc_feature (0)...(0): Accession number cg29195033
caagccattcatcgccgtgcggaccatagtaaccgaccgccgaaccattga

SEQ ID NO: 392 - DNA, 51 bp, Homo sapiens
  misc_feature (26)...(0): 2 of 2 allelic variants (391 is other entry)
  misc_feature (0)...(0): Accession number cg29195033
caagccattcatcgccgtgcggaccgtagtaaccgaccgccgaaccattga

SEQ ID NO: 393 - DNA, 51 bp, Homo sapiens
  misc_feature (26)...(0): 1 of 2 allelic variants (394 is other entry)
  misc_feature (0)...(0): Accession number cg29195033
attcatcgccgtgcggaccatagtaaccgaccgccgaaccattgaggaaga

SEQ ID NO: 394 - DNA, 51 bp, Homo sapiens
  misc_feature (26)...(0): 2 of 2 allelic variants (393 is other entry)
  misc_feature (0)...(0): Accession number cg29195033
attcatcgccgtgcggaccatagtagccgaccgccgaaccattgaggaaga

SEQ ID NO: 395 - DNA, 51 bp, Homo sapiens
  misc_feature (26)...(0): 1 of 2 allelic variants (396 is other entry)
  misc_feature (0)...(0): Accession number cg29195033
cgtgcggaccatagtaaccgaccgccgaaccattgaggaagatcctgcagc

SEQ ID NO: 396 - DNA, 51 bp, Homo sapiens
  misc_feature (26)...(0): 2 of 2 allelic variants (395 is other entry)
  misc_feature (0)...(0): Accession number cg29195033
cgtgcggaccatagtaaccgaccgctgaaccattgaggaagatcctgcagc

SEQ ID NO: 397 - DNA, 51 bp, Homo sapiens
  misc_feature (26)...(0): 1 of 2 allelic variants (398 is other entry)
  misc_feature (0)...(0): Accession number cg29195033
accgccgaaccattgaggaagatcctgcagcgcggcgaggatgctaaggcg

SEQ ID NO: 398 - DNA, 51 bp, Homo sapiens
  misc_feature (26)...(0): 2 of 2 allelic variants (397 is other entry)
  misc_feature (0)...(0): Accession number cg29195033
accgccgaaccattgaggaagatccggcagcgcggcgaggatgctaaggcg

SEQ ID NO: 399 - DNA, 51 bp, Homo sapiens
  misc_feature (26)...(0): 1 of 2 allelic variants (400 is other entry)
  misc_feature (0)...(0): Accession number cg29195033
acgaggttcaccggcccgctcatagtgtcgtcagtcagaatcttcatcatt

SEQ ID NO: 400 - DNA, 51 bp, Homo sapiens
  misc_feature (26)...(0): 2 of 2 allelic variants (399 is other entry)
  misc_feature (0)...(0): Accession number cg29195033
acgaggttcaccggcccgctcatagcgtcgtcagtcagaatcttcatcatt

SEQ ID NO: 401 - DNA, 51 bp, Homo sapiens
  misc_feature (26)...(0): 1 of 2 allelic variants (402 is other entry)
  misc_feature (0)...(0): Accession number cg29195033
cgtcagtcagaatcttcatcattgccgatacgtgatcgtgcaggctaatcc

SEQ ID NO: 402 - DNA, 51 bp, Homo sapiens
  misc_feature (26)...(0): 2 of 2 allelic variants (401 is other entry)
  misc_feature (0)...(0): Accession number cg29195033
cgtcagtcagaatcttcatcattgctgatacgtgatcgtgcaggctaatcc

SEQ ID NO: 403 - DNA, 51 bp, Homo sapiens
  misc_feature (26)...(0): 1 of 2 allelic variants (404 is other entry)
  misc_feature (0)...(0): Accession number cg29204207
gacactcccctcgacgcagcctccggagcggcgcgcactctccagaggcca

SEQ ID NO: 404 - DNA, 51 bp, Homo sapiens
  misc_feature (26)...(0): 2 of 2 allelic variants (403 is other entry)
  misc_feature (0)...(0): Accession number cg29204207
gacactcccctcgacgcagcctccgtagcggcgcgcactctccagaggcca

SEQ ID NO: 405 - DNA, 51 bp, Homo sapiens
  misc_feature (26)...(0): 1 of 2 allelic variants (406 is other entry)
  misc_feature (0)...(0): Accession number cg29207528
cgggcccgccctagccctcctcgatccagcgtggggacgccagatccacgt

SEQ ID NO: 406 - DNA, 51 bp, Homo sapiens
  misc_feature (26)...(0): 2 of 2 allelic variants (405 is other entry)
  misc_feature (0)...(0): Accession number cg29207528
cgggcccgccctagccctcctcgattcagcgtggggacgccagatccacgt

SEQ ID NO: 407 - DNA, 51 bp, Homo sapiens
  misc_feature (26)...(0): 1 of 2 allelic variants (408 is other entry)
  misc_feature (0)...(0): Accession number cg29207528
ggggacgccagatccacgtggagacgacagggtgccccagcgccgtggtct

SEQ ID NO: 408 - DNA, 51 bp, Homo sapiens
  misc_feature (26)...(0): 2 of 2 allelic variants (407 is other entry)
  misc_feature (0)...(0): Accession number cg29207528
ggggacgccagatccacgtggagacaacagggtgccccagcgccgtggtct

SEQ ID NO: 409 - DNA, 51 bp, Homo sapiens
  misc_feature (26)...(0): 1 of 2 allelic variants (410 is other entry)
  misc_feature (0)...(0): Accession number cg29207528
agatccacgtggagacgacagggtgccccagcgccgtggtctggaatccac

SEQ ID NO: 410 - DNA, 51 bp, Homo sapiens
  misc_feature (26)...(0): 2 of 2 allelic variants (409 is other entry)
  misc_feature (0)...(0): Accession number cg29207528
agatccacgtggagacgacagggtgtcccagcgccgtggtctggaatccac

SEQ ID NO: 411 - DNA, 51 bp, Homo sapiens
  misc_feature (26)...(0): 1 of 2 allelic variants (412 is other entry)
  misc_feature (0)...(0): Accession number cg29207528
acgtggagacgacagggtgccccagcgccgtggtctggaatccacgctcct

SEQ ID NO: 412 - DNA, 51 bp, Homo sapiens
  misc_feature (26)...(0): 2 of 2 allelic variants (411 is other entry)
  misc_feature (0)...(0): Accession number cg29207528
acgtggagacgacagggtgccccagtgccgtggtctggaatccacgctcct

SEQ ID NO: 413 - DNA, 51 bp, Homo sapiens
  misc_feature (26)...(0): 1 of 2 allelic variants (414 is other entry)
  misc_feature (0)...(0): Accession number cg29207528
gcgacctcaccatgtccacacggatcagcgtcgaaacgttgtgatcgctgc

SEQ ID NO: 414 - DNA, 51 bp, Homo sapiens
  misc_feature (26)...(0): 2 of 2 allelic variants (413 is other entry)
  misc_feature (0)...(0): Accession number cg29207528
gcgacctcaccatgtccacacggattagcgtcgaaacgttgtgatcgctgc

SEQ ID NO: 415 - DNA, 51 bp, Homo sapiens
  misc_feature (26)...(0): 1 of 2 allelic variants (416 is other entry)
  misc_feature (0)...(0): Accession number cg29214234
gacgcgtacctgccatcaggatcctcgtttgtttctgaagcaacccccttc

SEQ ID NO: 416 - DNA, 51 bp, Homo sapiens
  misc_feature (26)...(0): 2 of 2 allelic variants (415 is other entry)
  misc_feature (0)...(0): Accession number cg29214234
gacgcgtacctgccatcaggatccttgtttgtttctgaagcaacccccttc

SEQ ID NO: 417 - DNA, 51 bp, Homo sapiens
  misc_feature (26)...(0): 1 of 2 allelic variants (418 is other entry)
  misc_feature (0)...(0): Accession number cg29216983
ccgttgggccatacccgtctcgtgatcgaggaaggctcaacggaatgcatt

SEQ ID NO: 418 - DNA, 51 bp, Homo sapiens
  misc_feature (26)...(0): 2 of 2 allelic variants (417 is other entry)
  misc_feature (0)...(0): Accession number cg29216983
ccgttgggccatacccgtctcgtgaccgaggaaggctcaacggaatgcatt

SEQ ID NO: 419 - DNA, 51 bp, Homo sapiens
  misc_feature (26)...(0): 1 of 2 allelic variants (420 is other entry)
  misc_feature (0)...(0): Accession number cg29234854
gacgctgtgccgtgggatttcctcaacgaggctcaagagaggcacgcgtcg

SEQ ID NO: 420 - DNA, 51 bp, Homo sapiens
  misc_feature (26)...(0): 2 of 2 allelic variants (419 is other entry)
  misc_feature (0)...(0): Accession number cg29234854
gacgctgtgccgtgggatttcctcagcgaggctcaagagaggcacgcgtcg

SEQ ID NO: 421 - DNA, 51 bp, Homo sapiens
  misc_feature (26)...(0): 1 of 2 allelic variants (422 is other entry)
  misc_feature (0)...(0): Accession number cg29235319
cacacacacacacacacacacacacgcacgcacgcacgcacgcacgcaatg

SEQ ID NO: 422 - DNA, 51 bp, Homo sapiens
  misc_feature (26)...(0): 2 of 2 allelic variants (421 is other entry)
  misc_feature (0)...(0): Accession number cg29235319
cacacacacacacacacacacacacacacgcacgcacgcacgcacgcaatg

SEQ ID NO: 423 - DNA, 51 bp, Homo sapiens
  misc_feature (26)...(0): 1 of 2 allelic variants (424 is other entry)
  misc_feature (0)...(0): Accession number cg29242513
taacggttgagtaacacatcaaaacaccgttcgaggtcaagcctggcgtgt

SEQ ID NO: 424 - DNA, 51 bp, Homo sapiens
  misc_feature (26)...(0): 2 of 2 allelic variants (423 is other entry)
  misc_feature (0)...(0): Accession number cg29242513
taacggttgagtaacacatcaaaaccccgttcgaggtcaagcctggcgtgt

SEQ ID NO: 425 - DNA, 51 bp, Homo sapiens
  misc_feature (26)...(0): 1 of 2 allelic variants (426 is other entry)
  misc_feature (0)...(0): Accession number cg29254804
tacttcattttttttcctatttgcaacaacctgtaatgagtaactgtatta

SEQ ID NO: 426 - DNA, 51 bp, Homo sapiens
  misc_feature (26)...(0): 2 of 2 allelic variants (425 is other entry)
  misc_feature (0)...(0): Accession number cg29254804
tacttcattttttttcctatttgcagcaacctgtaatgagtaactgtatta

SEQ ID NO: 427 - DNA, 51 bp, Homo sapiens
  misc_feature (26)...(0): 1 of 2 allelic variants (428 is other entry)
  misc_feature (0)...(0): Accession number cg29345947
tagtgacaggcgcaatgcacaccgaacgggcgccaacagagcagccacgct

SEQ ID NO: 428 - DNA, 51 bp, Homo sapiens
  misc_feature (26)...(0): 2 of 2 allelic variants (427 is other entry)
  misc_feature (0)...(0): Accession number cg29345947
tagtgacaggcgcaatgcacaccgagcgggcgccaacagagcagccacgct

SEQ ID NO: 429 - DNA, 51 bp, Homo sapiens
  misc_feature (26)...(0): 1 of 2 allelic variants (430 is other entry)
  misc_feature (0)...(0): Accession number cg29352964
cgtcttgcccatattgacgccccgacgctgctgtcggtgtgggggagtgac

SEQ ID NO: 430 - DNA, 51 bp, Homo sapiens
  misc_feature (26)...(0): 2 of 2 allelic variants (429 is other entry)
  misc_feature (0)...(0): Accession number cg29352964
cgtcttgcccatattgacgccccgatgctgctgtcggtgtgggggagtgac

SEQ ID NO: 431 - DNA, 51 bp, Homo sapiens
  misc_feature (26)...(0): 1 of 2 allelic variants (432 is other entry)
  misc_feature (0)...(0): Accession number cg29357657
catgtgaggaggccggccatgaggtcgtcgtgctggacgacctatccgcgg

SEQ ID NO: 432 - DNA, 51 bp, Homo sapiens
  misc_feature (26)...(0): 2 of 2 allelic variants (431 is other entry)
  misc_feature (0)...(0): Accession number cg29357657
catgtgaggaggccggccatgaggttgtcgtgctggacgacctatccgcgg

SEQ ID NO: 433 - DNA, 51 bp, Homo sapiens
  misc_feature (26)...(0): 1 of 2 allelic variants (434 is other entry)
  misc_feature (0)...(0): Accession number cg29360558
cgtttatttatgcttttggttggttttcctttgataaatgcggcccttgct

SEQ ID NO: 434 - DNA, 51 bp, Homo sapiens
  misc_feature (26)...(0): 2 of 2 allelic variants (433 is other entry)
  misc_feature (0)...(0): Accession number cg29360558
cgtttatttatgcttttggttggttctcctttgataaatgcggcccttgct

SEQ ID NO: 435 - DNA, 51 bp, Homo sapiens
  misc_feature (26)...(0): 1 of 2 allelic variants (436 is other entry)
  misc_feature (0)...(0): Accession number cg29522548
ccataatcatttccaactctttcaaagtttttttaaatttcagctcaaaat

SEQ ID NO: 436 - DNA, 51 bp, Homo sapiens
  misc_feature (26)...(0): 2 of 2 allelic variants (435 is other entry)
  misc_feature (0)...(0): Accession number cg29522548
ccataatcatttccaactctttcaaggtttttttaaatttcagctcaaaat

SEQ ID NO: 437 - DNA, 51 bp, Homo sapiens
  misc_feature (26)...(0): 1 of 2 allelic variants (438 is other entry)
  misc_feature (0)...(0): Accession number cg30177683
ggctctatatcattgaaaacgaattctccacgcaaaacccacttcacacca

SEQ ID NO: 438 - DNA, 51 bp, Homo sapiens
  misc_feature (26)...(0): 2 of 2 allelic variants (437 is other entry)
  misc_feature (0)...(0): Accession number cg30177683
ggctctatatcattgaaaacgaattttccacgcaaaacccacttcacacca

SEQ ID NO: 439 - DNA, 51 bp, Homo sapiens
  misc_feature (26)...(0): 1 of 2 allelic variants (440 is other entry)
  misc_feature (0)...(0): Accession number cg30377599
tgaggcatctaaattttcacatcctgcctgtggagcagcaagctgaagaaa

SEQ ID NO: 440 - DNA, 51 bp, Homo sapiens
  misc_feature (26)...(0): 2 of 2 allelic variants (439 is other entry)
  misc_feature (0)...(0): Accession number cg30377599
tgaggcatctaaattttcacatccttcctgtggagcagcaagctgaagaaa

SEQ ID NO: 441 - DNA, 51 bp, Homo sapiens
  misc_feature (26)...(0): 1 of 2 allelic variants (442 is other entry)
  misc_feature (0)...(0): Accession number cg30790712
cagcaccgtggggtccagggtccactgtccaccaggacctactgcgtgggg

SEQ ID NO: 442 - DNA, 51 bp, Homo sapiens
  misc_feature (26)...(0): 2 of 2 allelic variants (441 is other entry)
  misc_feature (0)...(0): Accession number cg30790712
cagcaccgtggggtccagggtccaccgtccaccaggacctactgcgtgggg

SEQ ID NO: 443 - DNA, 51 bp, Homo sapiens
  misc_feature (26)...(0): 1 of 2 allelic variants (444 is other entry)
  misc_feature (0)...(0): Accession number cg32119538
ttccctaaatccaaagcgagcaaacaggagagagaaaccctgaaaatgggc

SEQ ID NO: 444 - DNA, 51 bp, Homo sapiens
  misc_feature (26)...(0): 2 of 2 allelic variants (443 is other entry)
  misc_feature (0)...(0): Accession number cg32119538
ttccctaaatccaaagcgagcaaaccggagagagaaaccctgaaaatgggc

SEQ ID NO: 445 - DNA, 51 bp, Homo sapiens
  misc_feature (26)...(0): 1 of 2 allelic variants (446 is other entry)
  misc_feature (0)...(0): Accession number cg32120712
ctcaacaggtggtgcactgggaccggcagccgcccggggtcccgcacgacc

SEQ ID NO: 446 - DNA, 50 bp, Homo sapiens
  misc_feature (26)...(0): 2 of 2 allelic variants (445 is other entry)
  misc_feature (25)...(26): nucleotide deleted between bases 25 and 26
  misc_feature (0)...(0): Accession number cg32120712
ctcaacaggtggtgcactgggaccgcagccgcccggggtcccgcacgacc

SEQ ID NO: 447 - DNA, 51 bp, Homo sapiens
  misc_feature (26)...(0): 1 of 2 allelic variants (448 is other entry)
  misc_feature (0)...(0): Accession number cg32128189
tcagctttattataatcttatgggaccatcatcatgtatgtggtccactgg

SEQ ID NO: 448 - DNA, 51 bp, Homo sapiens
  misc_feature (26)...(0): 2 of 2 allelic variants (447 is other entry)
  misc_feature (0)...(0): Accession number cg32128189
tcagctttattataatcttatgggatcatcatcatgtatgtggtccactgg

SEQ ID NO: 449 - DNA, 51 bp, Homo sapiens
  misc_feature (26)...(0): 1 of 2 allelic variants (450 is other entry)
  misc_feature (0)...(0): Accession number cg32153241
cggtgcggcaccattccaccgcgatcgacccggctccggtcccgaggtccc

SEQ ID NO: 450 - DNA, 51 bp, Homo sapiens
  misc_feature (26)...(0): 2 of 2 allelic variants (449 is other entry)
  misc_feature (0)...(0): Accession number cg32153241
cggtgcggcaccattccaccgcgattgacccggctccggtcccgaggtccc

SEQ ID NO: 451 - DNA, 51 bp, Homo sapiens
  misc_feature (26)...(0): 1 of 2 allelic variants (452 is other entry)
  misc_feature (0)...(0): Accession number cg32153241
ccaccgcgatcgacccggctccggtcccgaggtcccacagcagttgaccag

SEQ ID NO: 452 - DNA, 51 bp, Homo sapiens
  misc_feature (26)...(0): 2 of 2 allelic variants (451 is other entry)
  misc_feature (0)...(0): Accession number cg32153241
ccaccgcgatcgacccggctccggtaccgaggtcccacagcagttgaccag

SEQ ID NO: 453 - DNA, 51 bp, Homo sapiens
  misc_feature (26)...(0): 1 of 2 allelic variants (454 is other entry)
  misc_feature (0)...(0): Accession number cg32153241
tgggccgcagggctgccagcgcgacagctcgtaccgcgtgcttggtgataa

SEQ ID NO: 454 - DNA, 51 bp, Homo sapiens
  misc_feature (26)...(0): 2 of 2 allelic variants (453 is other entry)
  misc_feature (0)...(0): Accession number cg32153241
tgggccgcagggctgccagcgcgacggctcgtaccgcgtgcttggtgataa

SEQ ID NO: 455 - DNA, 51 bp, Homo sapiens
  misc_feature (26)...(0): 1 of 2 allelic variants (456 is other entry)
  misc_feature (0)...(0): Accession number cg32153241
aacgcggggtgggggagccgaagcctgtgtgacacaatcaaggggactcgc

SEQ ID NO: 456 - DNA, 51 bp, Homo sapiens
  misc_feature (26)...(0): 2 of 2 allelic variants (455 is other entry)
  misc_feature (0)...(0): Accession number cg32153241
aacgcggggtgggggagccgaagcccgtgtgacacaatcaaggggactcgc

SEQ ID NO: 457 - DNA, 51 bp, Homo sapiens
  misc_feature (26)...(0): 1 of 2 allelic variants (458 is other entry)
  misc_feature (0)...(0): Accession number cg32153241
ggtacgtgcgttggcggcccgctcaaccttgcgttctagcccgatcgcccg

SEQ ID NO: 458 - DNA, 51 bp, Homo sapiens
  misc_feature (26)...(0): 2 of 2 allelic variants (457 is other entry)
  misc_feature (0)...(0): Accession number cg32153241
ggtacgtgcgttggcggcccgctcagccttgcgttctagcccgatcgcccg

SEQ ID NO: 459 - DNA, 51 bp, Homo sapiens
  misc_feature (26)...(0): 1 of 2 allelic variants (460 is other entry)
  misc_feature (0)...(0): Accession number cg32153241
tggcggcccgctcaaccttgcgttctagcccgatcgcccgacaggtcgggt

SEQ ID NO: 460 - DNA, 51 bp, Homo sapiens
  misc_feature (26)...(0): 2 of 2 allelic variants (459 is other entry)
  misc_feature (0)...(0): Accession number cg32153241
tggcggcccgctcaaccttgcgttccagcccgatcgcccgacaggtcgggt

SEQ ID NO: 461 - DNA, 51 bp, Homo sapiens
  misc_feature (26)...(0): 1 of 2 allelic variants (462 is other entry)
  misc_feature (0)...(0): Accession number cg32153241
gttctagcccgatcgcccgacaggtcgggtcggtgcggcaccattccaccg

SEQ ID NO: 462 - DNA, 51 bp, Homo sapiens
  misc_feature (26)...(0): 2 of 2 allelic variants (461 is other entry)
  misc_feature (0)...(0): Accession number cg32153241
gttctagcccgatcgcccgacaggttgggtcggtgcggcaccattccaccg

SEQ ID NO: 463 - DNA, 51 bp, Homo sapiens
  misc_feature (26)...(0): 1 of 2 allelic variants (464 is other entry)
  misc_feature (0)...(0): Accession number cg32153241
gcccgatcgcccgacaggtcgggtcggtgcggcaccattccaccgcgatcg

SEQ ID NO: 464 - DNA, 51 bp, Homo sapiens
  misc_feature (26)...(0): 2 of 2 allelic variants (463 is other entry)
  misc_feature (0)...(0): Accession number cg32153241
gcccgatcgcccgacaggtcgggtcagtgcggcaccattccaccgcgatcg

SEQ ID NO: 465 - DNA, 51 bp, Homo sapiens
  misc_feature (26)...(0): 1 of 2 allelic variants (466 is other entry)
  misc_feature (0)...(0): Accession number cg32168828
tagggcaacgccaagttcgaagacgtccccctgtgcttttccgcctcactc

SEQ ID NO: 466 - DNA, 51 bp, Homo sapiens
  misc_feature (26)...(0): 2 of 2 allelic variants (465 is other entry)
  misc_feature (0)...(0): Accession number cg32168828
tagggcaacgccaagttcgaagacgcccccctgtgcttttccgcctcactc

SEQ ID NO: 467 - DNA, 51 bp, Homo sapiens
  misc_feature (26)...(0): 1 of 2 allelic variants (468 is other entry)
  misc_feature (0)...(0): Accession number cg32177197
tgacgagagtcccctgggacgaggggaaggaatggaaagcggtggggtcgt

SEQ ID NO: 468 - DNA, 51 bp, Homo sapiens
  misc_feature (26)...(0): 2 of 2 allelic variants (467 is other entry)
  misc_feature (0)...(0): Accession number cg32177197
tgacgagagtcccctgggacgagggaaaggaatggaaagcggtggggtcgt

SEQ ID NO: 469 - DNA, 51 bp, Homo sapiens
  misc_feature (26)...(0): 1 of 2 allelic variants (470 is other entry)
  misc_feature (0)...(0): Accession number cg32177197
atgtaccgtccgtccccttccacataatctggaggccgtaccaatcgggtg

SEQ ID NO: 470 - DNA, 51 bp, Homo sapiens
  misc_feature (26)...(0): 2 of 2 allelic variants (469 is other entry)
  misc_feature (0)...(0): Accession number cg32177197
atgtaccgtccgtccccttccacatgatctggaggccgtaccaatcgggtg

SEQ ID NO: 471 - DNA, 51 bp, Homo sapiens
  misc_feature (26)...(0): 1 of 2 allelic variants (472 is other entry)
  misc_feature (0)...(0): Accession number cg32180618
tgtgtgtgaaaatcagcacggtgcgcgtgaggggcgggcgcgcttctcaca

SEQ ID NO: 472 - DNA, 51 bp, Homo sapiens
  misc_feature (26)...(0): 2 of 2 allelic variants (471 is other entry)
  misc_feature (0)...(0): Accession number cg32180618
tgtgtgtgaaaatcagcacggtgcgtgtgaggggcgggcgcgcttctcaca

SEQ ID NO: 473 - DNA, 51 bp, Homo sapiens
  misc_feature (26)...(0): 1 of 2 allelic variants (474 is other entry)
  misc_feature (0)...(0): Accession number cg33206207
cagggatgacgccgccatgagttgggtgacgtgggcctgccgactgtctcc

SEQ ID NO: 474 - DNA, 51 bp, Homo sapiens
  misc_feature (26)...(0): 2 of 2 allelic variants (473 is other entry)
  misc_feature (0)...(0): Accession number cg33206207
cagggatgacgccgccatgagttggttgacgtgggcctgccgactgtctcc

SEQ ID NO: 475 - DNA, 51 bp, Homo sapiens
  misc_feature (26)...(0): 1 of 2 allelic variants (476 is other entry)
  misc_feature (0)...(0): Accession number cg34715517
tgatgcctcagcaaaaaattgtgctaaaaaaaaaaactggaagaaaagtac

SEQ ID NO: 476 - DNA, 50 bp, Homo sapiens
  misc_feature (26)...(0): 2 of 2 allelic variants (475 is other entry)
  misc_feature (25)...(26): nucleotide deleted between bases 25 and 26
  misc_feature (0)...(0): Accession number cg34715517
tgatgcctcagcaaaaaattgtgctaaaaaaaaaactggaagaaaagtac

SEQ ID NO: 477 - DNA, 51 bp, Homo sapiens
  misc_feature (26)...(0): 1 of 2 allelic variants (478 is other entry)
  misc_feature (0)...(0): Accession number cg35050153
cgacttgttcagcaccaggaggaggcgctggctgctgtcactggggctctg

SEQ ID NO: 478 - DNA, 51 bp, Homo sapiens
  misc_feature (26)...(0): 2 of 2 allelic variants (477 is other entry)
  misc_feature (0)...(0): Accession number cg35050153
cgacttgttcagcaccaggaggaggtgctggctgctgtcactggggctctg

SEQ ID NO: 479 - DNA, 51 bp, Homo sapiens
  misc_feature (26)...(0): 1 of 2 allelic variants (480 is other entry)
  misc_feature (0)...(0): Accession number cg35066497
tgtcgatctgatcggagaacttgccgccggtcttgtcgtcgacagtgttgc

SEQ ID NO: 480 - DNA, 51 bp, Homo sapiens
  misc_feature (26)...(0): 2 of 2 allelic variants (479 is other entry)
  misc_feature (0)...(0): Accession number cg35066497
tgtcgatctgatcggagaacttgccaccggtcttgtcgtcgacagtgttgc

SEQ ID NO: 481 - DNA, 51 bp, Homo sapiens
  misc_feature (26)...(0): 1 of 2 allelic variants (482 is other entry)
  misc_feature (0)...(0): Accession number cg35066497
ttgccgccggtcttgtcgtcgacagtgttgccagccttgtcgatgccctgc

SEQ ID NO: 482 - DNA, 51 bp, Homo sapiens
  misc_feature (26)...(0): 2 of 2 allelic variants (481 is other entry)
  misc_feature (0)...(0): Accession number cg35066497
ttgccgccggtcttgtcgtcgacagcgttgccagccttgtcgatgccctgc

SEQ ID NO: 483 - DNA, 51 bp, Homo sapiens
  misc_feature (26)...(0): 1 of 2 allelic variants (484 is other entry)
  misc_feature (0)...(0): Accession number cg35068462
gaggactcggcctgacgacggtcaccgtcattcatgacctcgacttggctg

SEQ ID NO: 484 - DNA, 51 bp, Homo sapiens
  misc_feature (26)...(0): 2 of 2 allelic variants (483 is other entry)
  misc_feature (0)...(0): Accession number cg35068462
gaggactcggcctgacgacggtcactgtcattcatgacctcgacttggctg

SEQ ID NO: 485 - DNA, 51 bp, Homo sapiens
  misc_feature (26)...(0): 1 of 2 allelic variants (486 is other entry)
  misc_feature (0)...(0): Accession number cg35341776
tcaattgctttttgtccgacatctcagacactctcttcaccatgactcagt

SEQ ID NO: 486 - DNA, 51 bp, Homo sapiens
  misc_feature (26)...(0): 2 of 2 allelic variants (485 is other entry)
  misc_feature (0)...(0): Accession number cg35341776
tcaattgctttttgtccgacatctcggacactctcttcaccatgactcagt

SEQ ID NO: 487 - DNA, 51 bp, Homo sapiens
  misc_feature (26)...(0): 1 of 2 allelic variants (488 is other entry)
  misc_feature (0)...(0): Accession number cg36508718
tggagcccggcgacaaccttgacatcaccgtgcatagcgccctcaacgatg

SEQ ID NO: 488 - DNA, 51 bp, Homo sapiens
  misc_feature (26)...(0): 2 of 2 allelic variants (487 is other entry)
  misc_feature (0)...(0): Accession number cg36508718
tggagcccggcgacaaccttgacattaccgtgcatagcgccctcaacgatg

SEQ ID NO: 489 - DNA, 51 bp, Homo sapiens
  misc_feature (26)...(0): 1 of 2 allelic variants (490 is other entry)
  misc_feature (0)...(0): Accession number cg36517624
gaactggcccagccaaactcttcaagctgctgcctaaagcctgggttgggg

SEQ ID NO: 490 - DNA, 51 bp, Homo sapiens
  misc_feature (26)...(0): 2 of 2 allelic variants (489 is other entry)
  misc_feature (0)...(0): Accession number cg36517624
gaactggcccagccaaactcttcaaactgctgcctaaagcctgggttgggg

SEQ ID NO: 491 - DNA, 51 bp, Homo sapiens
  misc_feature (26)...(0): 1 of 2 allelic variants (492 is other entry)
  misc_feature (0)...(0): Accession number cg36517624
tgatggcttcaagcacgtcccgccagcctagccccgtcacagtcatcacat

SEQ ID NO: 492 - DNA, 51 bp, Homo sapiens
  misc_feature (26)...(0): 2 of 2 allelic variants (491 is other entry)
  misc_feature (0)...(0): Accession number cg36517624
tgatggcttcaagcacgtcccgccaacctagccccgtcacagtcatcacat

SEQ ID NO: 493 - DNA, 51 bp, Homo sapiens
  misc_feature (26)...(0): 1 of 2 allelic variants (494 is other entry)
  misc_feature (0)...(0): Accession number cg36517624
cattctttgaagtgctttttgatgggtacctcaggggtatcagcgaccggg

SEQ ID NO: 494 - DNA, 51 bp, Homo sapiens
  misc_feature (26)...(0): 2 of 2 allelic variants (493 is other entry)
  misc_feature (0)...(0): Accession number cg36517624
cattctttgaagtgctttttgatggatacctcaggggtatcagcgaccggg

SEQ ID NO: 495 - DNA, 51 bp, Homo sapiens
  misc_feature (26)...(0): 1 of 2 allelic variants (496 is other entry)
  misc_feature (0)...(0): Accession number cg36517624
tgggtacctcaggggtatcagcgaccgggatgcgaaggtaggtgatatcct

SEQ ID NO: 496 - DNA, 51 bp, Homo sapiens
  misc_feature (26)...(0): 2 of 2 allelic variants (495 is other entry)
  misc_feature (0)...(0): Accession number cg36517624
tgggtacctcaggggtatcagcgactgggatgcgaaggtaggtgatatcct

SEQ ID NO: 497 - DNA, 51 bp, Homo sapiens
  misc_feature (26)...(0): 1 of 2 allelic variants (498 is other entry)
  misc_feature (0)...(0): Accession number cg36618790
ggcgaagcacctgaggtcaggagttcgagaccagcctggccaacatgacaa

SEQ ID NO: 498 - DNA, 51 bp, Homo sapiens
  misc_feature (26)...(0): 2 of 2 allelic variants (497 is other entry)
  misc_feature (0)...(0): Accession number cg36618790
ggcgaagcacctgaggtcaggagtttgagaccagcctggccaacatgacaa

SEQ ID NO: 499 - DNA, 50 bp, Homo sapiens
  misc_feature (26)...(0): 1 of 2 allelic variants (500 is other entry)
  misc_feature (25)...(26): nucleotide deleted between bases 25 and 26
  misc_feature (0)...(0): Accession number cg37003369
tcagttgatttaaggaataaaaaaagaccattttgctaaacactattaaa

SEQ ID NO: 500 - DNA, 51 bp, Homo sapiens
  misc_feature (26)...(0): 2 of 2 allelic variants (499 is other entry)
  misc_feature (0)...(0): Accession number cg37003369
tcagttgatttaaggaataaaaaaaagaccattttgctaaacactattaaa

SEQ ID NO: 501 - DNA, 51 bp, Homo sapiens
  misc_feature (26)...(0): 1 of 2 allelic variants (502 is other entry)
  misc_feature (0)...(0): Accession number cg37003369
tgtgacctgtgttcatagctaacatgagctctgacctccctacgccgggcg

SEQ ID NO: 502 - DNA, 51 bp, Homo sapiens
  misc_feature (26)...(0): 2 of 2 allelic variants (501 is other entry)
  misc_feature (0)...(0): Accession number cg37003369
tgtgacctgtgttcatagctaacataagctctgacctccctacgccgggcg

SEQ ID NO: 503 - DNA, 51 bp, Homo sapiens
  misc_feature (26)...(0): 1 of 2 allelic variants (504 is other entry)
  misc_feature (0)...(0): Accession number cg37026709
ggccgtgtgctggtaccagggatacccaggagctcagcagattttggcctc

SEQ ID NO: 504 - DNA, 51 bp, Homo sapiens
  misc_feature (26)...(0): 2 of 2 allelic variants (503 is other entry)
  misc_feature (0)...(0): Accession number cg37026709
ggccgtgtgctggtaccagggatacgcaggagctcagcagattttggcctc

SEQ ID NO: 505 - DNA, 51 bp, Homo sapiens
  misc_feature (26)...(0): 1 of 2 allelic variants (506 is other entry)
  misc_feature (0)...(0): Accession number cg38206730
aggcgtacacgtgcaggtgtgttacgtgttcattttcggctcaaggcgtac

SEQ ID NO: 506 - DNA, 51 bp, Homo sapiens
  misc_feature (26)...(0): 2 of 2 allelic variants (505 is other entry)
  misc_feature (0)...(0): Accession number cg38206730
aggcgtacacgtgcaggtgtgttacatgttcattttcggctcaaggcgtac

SEQ ID NO: 507 - DNA, 51 bp, Homo sapiens
  misc_feature (26)...(0): 1 of 2 allelic variants (508 is other entry)
  misc_feature (0)...(0): Accession number cg38278821
cgacggtactggttgctcctcgtatagaaagcggtgaatgcgaatgcaatg

SEQ ID NO: 508 - DNA, 51 bp, Homo sapiens
  misc_feature (26)...(0): 2 of 2 allelic variants (507 is other entry)
  misc_feature (0)...(0): Accession number cg38278821
cgacggtactggttgctcctcgtatggaaagcggtgaatgcgaatgcaatg

SEQ ID NO: 509 - DNA, 51 bp, Homo sapiens
  misc_feature (26)...(0): 1 of 2 allelic variants (510 is other entry)
  misc_feature (0)...(0): Accession number cg38403377
cgacgatctccccgcggtgtcgtccataggcgataccgcgagcattgacga

SEQ ID NO: 510 - DNA, 51 bp, Homo sapiens
  misc_feature (26)...(0): 2 of 2 allelic variants (509 is other entry)
  misc_feature (0)...(0): Accession number cg38403377
cgacgatctccccgcggtgtcgtccgtaggcgataccgcgagcattgacga

SEQ ID NO: 511 - DNA, 51 bp, Homo sapiens
  misc_feature (26)...(0): 1 of 2 allelic variants (512 is other entry)
  misc_feature (0)...(0): Accession number cg38403377
tccccgaaccgttgacgccgagaagaacattgttgttgtaaatcttcttga

SEQ ID NO: 512 - DNA, 51 bp, Homo sapiens
  misc_feature (26)...(0): 2 of 2 allelic variants (511 is other entry)
  misc_feature (0)...(0): Accession number cg38403377
tccccgaaccgttgacgccgagaaggacattgttgttgtaaatcttcttga

SEQ ID NO: 513 - DNA, 51 bp, Homo sapiens
  misc_feature (26)...(0): 1 of 2 allelic variants (514 is other entry)
  misc_feature (0)...(0): Accession number cg38403377
tcgttgcgtgccgtgagcgatccggacgttgcaccgggtcatcctgcggtg

SEQ ID NO: 514 - DNA, 51 bp, Homo sapiens
  misc_feature (26)...(0): 2 of 2 allelic variants (513 is other entry)
  misc_feature (0)...(0): Accession number cg38403377
tcgttgcgtgccgtgagcgatccgggcgttgcaccgggtcatcctgcggtg

SEQ ID NO: 515 - DNA, 51 bp, Homo sapiens
  misc_feature (26)...(0): 1 of 2 allelic variants (516 is other entry)
  misc_feature (0)...(0): Accession number cg38403377
cctcggtgtgagtggcgttcgttagcagtgatgcgatggcggtcgtgcgat

SEQ ID NO: 516 - DNA, 51 bp, Homo sapiens
  misc_feature (26)...(0): 2 of 2 allelic variants (515 is other entry)
  misc_feature (0)...(0): Accession number cg38403377
cctcggtgtgagtggcgttcgttagtagtgatgcgatggcggtcgtgcgat

SEQ ID NO: 517 - DNA, 51 bp, Homo sapiens
  misc_feature (26)...(0): 1 of 2 allelic variants (518 is other entry)
  misc_feature (0)...(0): Accession number cg38446357
tttcctcgctgggtatctccgcgacccctcgggcccgtagaccgtcctcga

SEQ ID NO: 518 - DNA, 51 bp, Homo sapiens
  misc_feature (26)...(0): 2 of 2 allelic variants (517 is other entry)
  misc_feature (0)...(0): Accession number cg38446357
tttcctcgctgggtatctccgcgactcctcgggcccgtagaccgtcctcga

SEQ ID NO: 519 - DNA, 51 bp, Homo sapiens
  misc_feature (26)...(0): 1 of 2 allelic variants (520 is other entry)
  misc_feature (0)...(0): Accession number cg38446677
cacctcccatcggaatgacgtacgtggtcagagacgatccgaccgtcgtgc

SEQ ID NO: 520 - DNA, 51 bp, Homo sapiens
  misc_feature (26)...(0): 2 of 2 allelic variants (519 is other entry)
  misc_feature (0)...(0): Accession number cg38446677
cacctcccatcggaatgacgtacgtcgtcagagacgatccgaccgtcgtgc

SEQ ID NO: 521 - DNA, 51 bp, Homo sapiens
  misc_feature (26)...(0): 1 of 2 allelic variants (522 is other entry)
  misc_feature (0)...(0): Accession number cg38446677
tcgtcgccgaaagcagaatggccatgacttcgacggcggtggccgagtcga

SEQ ID NO: 522 - DNA, 51 bp, Homo sapiens
  misc_feature (26)...(0): 2 of 2 allelic variants (521 is other entry)
  misc_feature (0)...(0): Accession number cg38446677
tcgtcgccgaaagcagaatggccatcacttcgacggcggtggccgagtcga

SEQ ID NO: 523 - DNA, 51 bp, Homo sapiens
  misc_feature (26)...(0): 1 of 2 allelic variants (524 is other entry)
  misc_feature (0)...(0): Accession number cg38446677
gaaagcagaatggccatgacttcgacggcggtggccgagtcgagggctccg

SEQ ID NO: 524 - DNA, 51 bp, Homo sapiens
  misc_feature (26)...(0): 2 of 2 allelic variants (523 is other entry)
  misc_feature (0)...(0): Accession number cg38446677
gaaagcagaatggccatgacttcgatggcggtggccgagtcgagggctccg

SEQ ID NO: 525 - DNA, 50 bp, Homo sapiens
  misc_feature (26)...(0): 1 of 2 allelic variants (526 is other entry)
  misc_feature (25)...(26): nucleotide deleted between bases 25 and 26
  misc_feature (0)...(0): Accession number cg38869031
acattgattgttcacatttttttttctcttctcaatttcccttgattata

SEQ ID NO: 526 - DNA, 51 bp, Homo sapiens
  misc_feature (26)...(0): 2 of 2 allelic variants (525 is other entry)
  misc_feature (0)...(0): Accession number cg38869031
acattgattgttcacattttttttttctcttctcaatttcccttgattata

SEQ ID NO: 527 - DNA, 51 bp, Homo sapiens
  misc_feature (26)...(0): 1 of 2 allelic variants (528 is other entry)
  misc_feature (0)...(0): Accession number cg38925867
gcaacggagatgactcacaagctcgttacgaggcggtaaggctcacccgcg

SEQ ID NO: 528 - DNA, 51 bp, Homo sapiens
  misc_feature (26)...(0): 2 of 2 allelic variants (527 is other entry)
  misc_feature (0)...(0): Accession number cg38925867
gcaacggagatgactcacaagctcgctacgaggcggtaaggctcacccgcg

SEQ ID NO: 529 - DNA, 51 bp, Homo sapiens
  misc_feature (26)...(0): 1 of 2 allelic variants (530 is other entry)
  misc_feature (0)...(0): Accession number cg38925867
aaggccagtagcactcgtgcagttgggacgatgagacgttggcctcgcggc

SEQ ID NO: 530 - DNA, 51 bp, Homo sapiens
  misc_feature (26)...(0): 2 of 2 allelic variants (529 is other entry)
  misc_feature (0)...(0): Accession number cg38925867
aaggccagtagcactcgtgcagttgcgacgatgagacgttggcctcgcggc

SEQ ID NO: 531 - DNA, 51 bp, Homo sapiens
  misc_feature (26)...(0): 1 of 2 allelic variants (532 is other entry)
  misc_feature (0)...(0): Accession number cg39373569
aacatcttgaaaatacacaagtggtgcaaagatgtgtcacgttctggacct

SEQ ID NO: 532 - DNA, 51 bp, Homo sapiens
  misc_feature (26)...(0): 2 of 2 allelic variants (531 is other entry)
  misc_feature (0)...(0): Accession number cg39373569
aacatcttgaaaatacacaagtggtacaaagatgtgtcacgttctggacct

SEQ ID NO: 533 - DNA, 51 bp, Homo sapiens
  misc_feature (26)...(0): 1 of 2 allelic variants (534 is other entry)
  misc_feature (0)...(0): Accession number cg39380084
cctcgttgccttatctccagattcctcaatttctgtgaaacgtaaacatta

SEQ ID NO: 534 - DNA, 51 bp, Homo sapiens
  misc_feature (26)...(0): 2 of 2 allelic variants (533 is other entry)
  misc_feature (0)...(0): Accession number cg39380084
cctcgttgccttatctccagattccccaatttctgtgaaacgtaaacatta

SEQ ID NO: 535 - DNA, 51 bp, Homo sapiens
  misc_feature (26)...(0): 1 of 2 allelic variants (536 is other entry)
  misc_feature (0)...(0): Accession number cg39380084
ttatctccagattcctcaatttctgtgaaacgtaaacattatgggaatagt

SEQ ID NO: 536 - DNA, 51 bp, Homo sapiens
  misc_feature (26)...(0): 2 of 2 allelic variants (535 is other entry)
  misc_feature (0)...(0): Accession number cg39380084
ttatctccagattcctcaatttctgggaaacgtaaacattatgggaatagt

SEQ ID NO: 537 - DNA, 51 bp, Homo sapiens
  misc_feature (26)...(0): 1 of 2 allelic variants (538 is other entry)
  misc_feature (0)...(0): Accession number cg39402442
ttcttctctgccattcctggagattttgaaaagagttggtaatgtgtttca

SEQ ID NO: 538 - DNA, 51 bp, Homo sapiens
  misc_feature (26)...(0): 2 of 2 allelic variants (537 is other entry)
  misc_feature (0)...(0): Accession number cg39402442
ttcttctctgccattcctggagattctgaaaagagttggtaatgtgtttca

SEQ ID NO: 539 - DNA, 51 bp, Homo sapiens
  misc_feature (26)...(0): 1 of 2 allelic variants (540 is other entry)
  misc_feature (0)...(0): Accession number cg39404391
ttagcccaacagcctggcacaaaggacaacaatgaggagaggaaaggggag

SEQ ID NO: 540 - DNA, 51 bp, Homo sapiens
  misc_feature (26)...(0): 2 of 2 allelic variants (539 is other entry)
  misc_feature (0)...(0): Accession number cg39404391
ttagcccaacagcctggcacaaagggcaacaatgaggagaggaaaggggag

SEQ ID NO: 541 - DNA, 51 bp, Homo sapiens
  misc_feature (26)...(0): 1 of 2 allelic variants (542 is other entry)
  misc_feature (0)...(0): Accession number cg39404391
gattcctacactatccccaaaatggcagagctgggctctccctgcagtggc

SEQ ID NO: 542 - DNA, 51 bp, Homo sapiens
  misc_feature (26)...(0): 2 of 2 allelic variants (541 is other entry)
  misc_feature (0)...(0): Accession number cg39404391
gattcctacactatccccaaaatggtagagctgggctctccctgcagtggc

SEQ ID NO: 543 - DNA, 51 bp, Homo sapiens
  misc_feature (26)...(0): 1 of 2 allelic variants (544 is other entry)
  misc_feature (0)...(0): Accession number cg39435025
aaactttaacgtgttatatcattcaaggcgtaacttatacgcgcggggtac

SEQ ID NO: 544 - DNA, 51 bp, Homo sapiens
  misc_feature (26)...(0): 2 of 2 allelic variants (543 is other entry)
  misc_feature (0)...(0): Accession number cg39435025
aaactttaacgtgttatatcattcatggcgtaacttatacgcgcggggtac

SEQ ID NO: 545 - DNA, 51 bp, Homo sapiens
  misc_feature (26)...(0): 1 of 2 allelic variants (546 is other entry)
  misc_feature (0)...(0): Accession number cg39485034
ccgcccaggaattcgtgagtttccaagttgctgagccattgcccggattcc

SEQ ID NO: 546 - DNA, 51 bp, Homo sapiens
  misc_feature (26)...(0): 2 of 2 allelic variants (545 is other entry)
  misc_feature (0)...(0): Accession number cg39485034
ccgcccaggaattcgtgagtttccaggttgctgagccattgcccggattcc

SEQ ID NO: 547 - DNA, 51 bp, Homo sapiens
  misc_feature (26)...(0): 1 of 2 allelic variants (548 is other entry)
  misc_feature (0)...(0): Accession number cg39485034
agtacaggcgatcgctgccaccgttagaccatgggagcaggtaggacccgc

SEQ ID NO: 548 - DNA, 51 bp, Homo sapiens
  misc_feature (26)...(0): 2 of 2 allelic variants (547 is other entry)
  misc_feature (0)...(0): Accession number cg39485034
agtacaggcgatcgctgccaccgttggaccatgggagcaggtaggacccgc

SEQ ID NO: 549 - DNA, 51 bp, Homo sapiens
  misc_feature (26)...(0): 1 of 2 allelic variants (550 is other entry)
  misc_feature (0)...(0): Accession number cg39485034
ggcgatcgctgccaccgttagaccatgggagcaggtaggacccgccttcct

SEQ ID NO: 550 - DNA, 51 bp, Homo sapiens
  misc_feature (26)...(0): 2 of 2 allelic variants (549 is other entry)
  misc_feature (0)...(0): Accession number cg39485034
ggcgatcgctgccaccgttagaccaggggagcaggtaggacccgccttcct

SEQ ID NO: 551 - DNA, 51 bp, Homo sapiens
  misc_feature (26)...(0): 1 of 2 allelic variants (552 is other entry)
  misc_feature (0)...(0): Accession number cg39485034
gacccgagatggacttcttcgacgaagttgccacggctccgttagcgaaag

SEQ ID NO: 552 - DNA, 51 bp, Homo sapiens
  misc_feature (26)...(0): 2 of 2 allelic variants (551 is other entry)
  misc_feature (0)...(0): Accession number cg39485034
gacccgagatggacttcttcgacgaggttgccacggctccgttagcgaaag

SEQ ID NO: 553 - DNA, 51 bp, Homo sapiens
  misc_feature (26)...(0): 1 of 2 allelic variants (554 is other entry)
  misc_feature (0)...(0): Accession number cg39485034
gacttcttcgacgaagttgccacggctccgttagcgaaagcgatacggccg

SEQ ID NO: 554 - DNA, 51 bp, Homo sapiens
  misc_feature (26)...(0): 2 of 2 allelic variants (553 is other entry)
  misc_feature (0)...(0): Accession number cg39485034
gacttcttcgacgaagttgccacggttccgttagcgaaagcgatacggccg

SEQ ID NO: 555 - DNA, 51 bp, Homo sapiens
  misc_feature (26)...(0): 1 of 2 allelic variants (556 is other entry)
  misc_feature (0)...(0): Accession number cg39515553
cgcactaaaccttaaaaatgcgagagcgcatgcacggcggacgtcgtggaa

SEQ ID NO: 556 - DNA, 50 bp, Homo sapiens
  misc_feature (26)...(0): 2 of 2 allelic variants (555 is other entry)
  misc_feature (25)...(26): nucleotide deleted between bases 25 and 26
  misc_feature (0)...(0): Accession number cg39515553
cgcactaaaccttaaaaatgcgagacgcatgcacggcggacgtcgtggaa

SEQ ID NO: 557 - DNA, 51 bp, Homo sapiens
  misc_feature (26)...(0): 1 of 2 allelic variants (558 is other entry)
  misc_feature (0)...(0): Accession number cg39515553
tgtgtccggagaaacctcgtgcggaaaacagcgcaaaccgcaaaaaccccg

SEQ ID NO: 558 - DNA, 51 bp, Homo sapiens
  misc_feature (26)...(0): 2 of 2 allelic variants (557 is other entry)
  misc_feature (0)...(0): Accession number cg39515553
tgtgtccggagaaacctcgtgcggagaacagcgcaaaccgcaaaaaccccg

SEQ ID NO: 559 - DNA, 51 bp, Homo sapiens
  misc_feature (26)...(0): 1 of 2 allelic variants (560 is other entry)
  misc_feature (0)...(0): Accession number cg39516001
cgaaatggaaaatcgtcaatgaagaaccgaaatacgatgctaaagttattc

SEQ ID NO: 560 - DNA, 51 bp, Homo sapiens
  misc_feature (26)...(0): 2 of 2 allelic variants (559 is other entry)
  misc_feature (0)...(0): Accession number cg39516001
cgaaatggaaaatcgtcaatgaagagccgaaatacgatgctaaagttattc

SEQ ID NO: 561 - DNA, 51 bp, Homo sapiens
  misc_feature (26)...(0): 1 of 2 allelic variants (562 is other entry)
  misc_feature (0)...(0): Accession number cg39517070
gccgcccaaacaacgctcaccgttacacgccgcaatcgaggcgtctcaacc

SEQ ID NO: 562 - DNA, 51 bp, Homo sapiens
  misc_feature (26)...(0): 2 of 2 allelic variants (561 is other entry)
  misc_feature (0)...(0): Accession number cg39517070
gccgcccaaacaacgctcaccgttatacgccgcaatcgaggcgtctcaacc

SEQ ID NO: 563 - DNA, 51 bp, Homo sapiens
  misc_feature (26)...(0): 1 of 2 allelic variants (564 is other entry)
  misc_feature (0)...(0): Accession number cg39517070
tgtttgcgctccacaggggaccgcaccgccactccatccacagcgcaaaca

SEQ ID NO: 564 - DNA, 51 bp, Homo sapiens
  misc_feature (26)...(0): 2 of 2 allelic variants (563 is other entry)
  misc_feature (0)...(0): Accession number cg39517070
tgtttgcgctccacaggggaccgcatcgccactccatccacagcgcaaaca

SEQ ID NO: 565 - DNA, 51 bp, Homo sapiens
  misc_feature (26)...(0): 1 of 2 allelic variants (566 is other entry)
  misc_feature (0)...(0): Accession number cg39517875
gctgacggatgaacgtctcggacacagcggacacctcagtgaatctccctt

SEQ ID NO: 566 - DNA, 51 bp, Homo sapiens
  misc_feature (26)...(0): 2 of 2 allelic variants (565 is other entry)
  misc_feature (0)...(0): Accession number cg39517875
gctgacggatgaacgtctcggacacggcggacacctcagtgaatctccctt

SEQ ID NO: 567 - DNA, 51 bp, Homo sapiens
  misc_feature (26)...(0): 1 of 2 allelic variants (568 is other entry)
  misc_feature (0)...(0): Accession number cg39517875
gacacagcggacacctcagtgaatctccctttgagtagatactggacgaga

SEQ ID NO: 568 - DNA, 51 bp, Homo sapiens
  misc_feature (26)...(0): 2 of 2 allelic variants (567 is other entry)
  misc_feature (0)...(0): Accession number cg39517875
gacacagcggacacctcagtgaatcgccctttgagtagatactggacgaga

SEQ ID NO: 569 - DNA, 51 bp, Homo sapiens
  misc_feature (26)...(0): 1 of 2 allelic variants (570 is other entry)
  misc_feature (0)...(0): Accession number cg39523703
gcacaggagagcggccgagaccgggcgcagcccctccgacatcatgcgcac

SEQ ID NO: 570 - DNA, 51 bp, Homo sapiens
  misc_feature (26)...(0): 2 of 2 allelic variants (569 is other entry)
  misc_feature (0)...(0): Accession number cg39523703
gcacaggagagcggccgagaccgggtgcagcccctccgacatcatgcgcac

SEQ ID NO: 571 - DNA, 51 bp, Homo sapiens
  misc_feature (26)...(0): 1 of 2 allelic variants (572 is other entry)
  misc_feature (0)...(0): Accession number cg39524728
atatgcatatgtatgcactcatacactcatacatatgtgccccctcagaga

SEQ ID NO: 572 - DNA, 51 bp, Homo sapiens
  misc_feature (26)...(0): 2 of 2 allelic variants (571 is other entry)
  misc_feature (0)...(0): Accession number cg39524728
atatgcatatgtatgcactcatacattcatacatatgtgccccctcagaga

SEQ ID NO: 573 - DNA, 51 bp, Homo sapiens
  misc_feature (26)...(0): 1 of 2 allelic variants (574 is other entry)
  misc_feature (0)...(0): Accession number cg39527111
ggcgacatgggcgtccccacggccccggaggccggcagctggcgctgggga

SEQ ID NO: 574 - DNA, 51 bp, Homo sapiens
  misc_feature (26)...(0): 2 of 2 allelic variants (573 is other entry)
  misc_feature (0)...(0): Accession number cg39527111
ggcgacatgggcgtccccacggccctggaggccggcagctggcgctgggga

SEQ ID NO: 575 - DNA, 51 bp, Homo sapiens
  misc_feature (26)...(0): 1 of 2 allelic variants (576 is other entry)
  misc_feature (0)...(0): Accession number cg39530245
gacattctcattcagagcggagaaatttcagcagatttcaaggagccgcca

SEQ ID NO: 576 - DNA, 51 bp, Homo sapiens
  misc_feature (26)...(0): 2 of 2 allelic variants (575 is other entry)
  misc_feature (0)...(0): Accession number cg39530245
gacattctcattcagagcggagaaaattcagcagatttcaaggagccgcca

SEQ ID NO: 577 - DNA, 51 bp, Homo sapiens
  misc_feature (26)...(0): 1 of 2 allelic variants (578 is other entry)
  misc_feature (0)...(0): Accession number cg39530249
acaagccttcactttcttttcttttcttttttttttatctaacaactgaag

SEQ ID NO: 578 - DNA, 50 bp, Homo sapiens
  misc_feature (26)...(0): 2 of 2 allelic variants (577 is other entry)
  misc_feature (25)...(26): nucleotide deleted between bases 25 and 26
  misc_feature (0)...(0): Accession number cg39530249
acaagccttcactttcttttcttttttttttttttatctaacaactgaag

SEQ ID NO: 579 - DNA, 51 bp, Homo sapiens
  misc_feature (26)...(0): 1 of 2 allelic variants (580 is other entry)
  misc_feature (0)...(0): Accession number cg39535150
cggctctcctggatgtgcccccgcaacaatgccaggtaagccttggtcacg

SEQ ID NO: 580 - DNA, 51 bp, Homo sapiens
  misc_feature (26)...(0): 2 of 2 allelic variants (579 is other entry)
  misc_feature (0)...(0): Accession number cg39535150
cggctctcctggatgtgcccccgcagcaatgccaggtaagccttggtcacg

SEQ ID NO: 581 - DNA, 51 bp, Homo sapiens
  misc_feature (26)...(0): 1 of 2 allelic variants (582 is other entry)
  misc_feature (0)...(0): Accession number cg39536028
ctggcacacagtatcccaaccatgggtttagtgtccaccagacttaaagga

SEQ ID NO: 582 - DNA, 51 bp, Homo sapiens
  misc_feature (26)...(0): 2 of 2 allelic variants (581 is other entry)
  misc_feature (0)...(0): Accession number cg39536028
ctggcacacagtatcccaaccatggatttagtgtccaccagacttaaagga

SEQ ID NO: 583 - DNA, 51 bp, Homo sapiens
  misc_feature (26)...(0): 1 of 2 allelic variants (584 is other entry)
  misc_feature (0)...(0): Accession number cg39543172
atgtgtctcccacactggccgctgcacaagctgagaagctgggacggcccg

SEQ ID NO: 584 - DNA, 51 bp, Homo sapiens
  misc_feature (26)...(0): 2 of 2 allelic variants (583 is other entry)
  misc_feature (0)...(0): Accession number cg39543172
atgtgtctcccacactggccgctgctcaagctgagaagctgggacggcccg

SEQ ID NO: 585 - DNA, 51 bp, Homo sapiens
  misc_feature (26)...(0): 1 of 2 allelic variants (586 is other entry)
  misc_feature (0)...(0): Accession number cg39545648
gcaattttactctacagctgagacactgccaaagagtccagaattgtgaag

SEQ ID NO: 586 - DNA, 51 bp, Homo sapiens
  misc_feature (26)...(0): 2 of 2 allelic variants (585 is other entry)
  misc_feature (0)...(0): Accession number cg39545648
gcaattttactctacagctgagacattgccaaagagtccagaattgtgaag

SEQ ID NO: 587 - DNA, 51 bp, Homo sapiens
  misc_feature (26)...(0): 1 of 2 allelic variants (588 is other entry)
  misc_feature (0)...(0): Accession number cg39547799
aaagttggagaaacagaaaccaaggcgaggtggtccttggttaagtctgca

SEQ ID NO: 588 - DNA, 51 bp, Homo sapiens
  misc_feature (26)...(0): 2 of 2 allelic variants (587 is other entry)
  misc_feature (0)...(0): Accession number cg39547799
aaagttggagaaacagaaaccaaggtgaggtggtccttggttaagtctgca

SEQ ID NO: 589 - DNA, 51 bp, Homo sapiens
  misc_feature (26)...(0): 1 of 2 allelic variants (590 is other entry)
  misc_feature (0)...(0): Accession number cg39550340
tttttttaaataacatcgttgattaaaacaatcctattcactgcagtcaca

SEQ ID NO: 590 - DNA, 51 bp, Homo sapiens
  misc_feature (26)...(0): 2 of 2 allelic variants (589 is other entry)
  misc_feature (0)...(0): Accession number cg39550340
tttttttaaataacatcgttgattagaacaatcctattcactgcagtcaca

SEQ ID NO: 591 - DNA, 51 bp, Homo sapiens
  misc_feature (26)...(0): 1 of 2 allelic variants (592 is other entry)
  misc_feature (0)...(0): Accession number cg39568672
gctgggtggctgaccagcgctttggccagtcaggggttcggtggaatgttc

SEQ ID NO: 592 - DNA, 51 bp, Homo sapiens
  misc_feature (26)...(0): 2 of 2 allelic variants (591 is other entry)
  misc_feature (0)...(0): Accession number cg39568672
gctgggtggctgaccagcgctttggtcagtcaggggttcggtggaatgttc

SEQ ID NO: 593 - DNA, 51 bp, Homo sapiens
  misc_feature (26)...(0): 1 of 2 allelic variants (594 is other entry)
  misc_feature (0)...(0): Accession number cg39568672
taccacggcatcatggtcgctttcgcgctcgttgggtacggatggcttgcg

SEQ ID NO: 594 - DNA, 51 bp, Homo sapiens
  misc_feature (26)...(0): 2 of 2 allelic variants (593 is other entry)
  misc_feature (0)...(0): Accession number cg39568672
taccacggcatcatggtcgctttcgtgctcgttgggtacggatggcttgcg

SEQ ID NO: 595 - DNA, 51 bp, Homo sapiens
  misc_feature (26)...(0): 1 of 2 allelic variants (596 is other entry)
  misc_feature (0)...(0): Accession number cg39568672
tcgggtatcaggccgttgacatggcacccgcttgttatcgattctctcatc

SEQ ID NO: 596 - DNA, 51 bp, Homo sapiens
  misc_feature (26)...(0): 2 of 2 allelic variants (595 is other entry)
  misc_feature (0)...(0): Accession number cg39568672
tcgggtatcaggccgttgacatggcgcccgcttgttatcgattctctcatc

SEQ ID NO: 597 - DNA, 51 bp, Homo sapiens
  misc_feature (26)...(0): 1 of 2 allelic variants (598 is other entry)
  misc_feature (0)...(0): Accession number cg39570661
acgaggggagcaagcacgagccggggagagagctctgcgctcgcacacggg

SEQ ID NO: 598 - DNA, 51 bp, Homo sapiens
  misc_feature (26)...(0): 2 of 2 allelic variants (597 is other entry)
  misc_feature (0)...(0): Accession number cg39570661
acgaggggagcaagcacgagccgggaagagagctctgcgctcgcacacggg

SEQ ID NO: 599 - DNA, 51 bp, Homo sapiens
  misc_feature (26)...(0): 1 of 2 allelic variants (600 is other entry)
  misc_feature (0)...(0): Accession number cg39575840
cccatggtcctccccatgtaaagagctctggccaatcaacaaggagtggac

SEQ ID NO: 600 - DNA, 51 bp, Homo sapiens
  misc_feature (26)...(0): 2 of 2 allelic variants (599 is other entry)
  misc_feature (0)...(0): Accession number cg39575840
cccatggtcctccccatgtaaagagttctggccaatcaacaaggagtggac

SEQ ID NO: 601 - DNA, 51 bp, Homo sapiens
  misc_feature (26)...(0): 1 of 2 allelic variants (602 is other entry)
  misc_feature (0)...(0): Accession number cg39575840
aggagtggacagctcatacaaggaccaccaagtggccaacaaacataaagc

SEQ ID NO: 602 - DNA, 51 bp, Homo sapiens
  misc_feature (26)...(0): 2 of 2 allelic variants (601 is other entry)
  misc_feature (0)...(0): Accession number cg39575840
aggagtggacagctcatacaaggacgaccaagtggccaacaaacataaagc

SEQ ID NO: 603 - DNA, 51 bp, Homo sapiens
  misc_feature (26)...(0): 1 of 2 allelic variants (604 is other entry)
  misc_feature (0)...(0): Accession number cg39602316
tagcaggaggaagctgatgaattgaagtccgatataggcagtttgtgctcc

SEQ ID NO: 604 - DNA, 51 bp, Homo sapiens
  misc_feature (26)...(0): 2 of 2 allelic variants (603 is other entry)
  misc_feature (0)...(0): Accession number cg39602316
tagcaggaggaagctgatgaattgaggtccgatataggcagtttgtgctcc

SEQ ID NO: 605 - DNA, 51 bp, Homo sapiens
  misc_feature (26)...(0): 1 of 2 allelic variants (606 is other entry)
  misc_feature (0)...(0): Accession number cg39704218
caaactcctgggctcaagcgatcctccaaccccggcctcccaaagtgctgg

SEQ ID NO: 606 - DNA, 51 bp, Homo sapiens
  misc_feature (26)...(0): 2 of 2 allelic variants (605 is other entry)
  misc_feature (0)...(0): Accession number cg39704218
caaactcctgggctcaagcgatccttcaaccccggcctcccaaagtgctgg

SEQ ID NO: 607 - DNA, 51 bp, Homo sapiens
  misc_feature (26)...(0): 1 of 2 allelic variants (608 is other entry)
  misc_feature (0)...(0): Accession number cg41085637
aagacggccatgaggaggcgatggaaacggaggccagcacatcaggggagg

SEQ ID NO: 608 - DNA, 51 bp, Homo sapiens
  misc_feature (26)...(0): 2 of 2 allelic variants (607 is other entry)
  misc_feature (0)...(0): Accession number cg41085637
aagacggccatgaggaggcgatggagacggaggccagcacatcaggggagg

SEQ ID NO: 609 - DNA, 51 bp, Homo sapiens
  misc_feature (26)...(0): 1 of 2 allelic variants (610 is other entry)
  misc_feature (0)...(0): Accession number cg41591473
aaattgacatttaagtggacctgccgtatttgtatttgctaaatctggcca

SEQ ID NO: 610 - DNA, 51 bp, Homo sapiens
  misc_feature (26)...(0): 2 of 2 allelic variants (609 is other entry)
  misc_feature (0)...(0): Accession number cg41591473
aaattgacatttaagtggacctgccatatttgtatttgctaaatctggcca

SEQ ID NO: 611 - DNA, 51 bp, Homo sapiens
  misc_feature (26)...(0): 1 of 2 allelic variants (612 is other entry)
  misc_feature (0)...(0): Accession number cg41592212
acgcgtgagccaccatgcccgacgtgaagacaggaatttatacccatggag

SEQ ID NO: 612 - DNA, 51 bp, Homo sapiens
  misc_feature (26)...(0): 2 of 2 allelic variants (611 is other entry)
  misc_feature (0)...(0): Accession number cg41592212
acgcgtgagccaccatgcccgacgttaagacaggaatttatacccatggag

SEQ ID NO: 613 - DNA, 51 bp, Homo sapiens
  misc_feature (26)...(0): 1 of 2 allelic variants (614 is other entry)
  misc_feature (0)...(0): Accession number cg41618657
caattggctgtcctatttacacttacgtgtcatgttaaaataatcatttct

SEQ ID NO: 614 - DNA, 51 bp, Homo sapiens
  misc_feature (26)...(0): 2 of 2 allelic variants (613 is other entry)
  misc_feature (0)...(0): Accession number cg41618657
caattggctgtcctatttacacttatgtgtcatgttaaaataatcatttct

SEQ ID NO: 615 - DNA, 51 bp, Homo sapiens
  misc_feature (26)...(0): 1 of 2 allelic variants (616 is other entry)
  misc_feature (0)...(0): Accession number cg42267484
gaacatcccatgcaaaagacttttcaaagggaagggcctggtttgagaatg

SEQ ID NO: 616 - DNA, 51 bp, Homo sapiens
  misc_feature (26)...(0): 2 of 2 allelic variants (615 is other entry)
  misc_feature (0)...(0): Accession number cg42267484
gaacatcccatgcaaaagacttttcgaagggaagggcctggtttgagaatg

SEQ ID NO: 617 - DNA, 51 bp, Homo sapiens
  misc_feature (26)...(0): 1 of 2 allelic variants (618 is other entry)
  misc_feature (0)...(0): Accession number cg42312996
tcacctccttccctttattctaccgtcccaagggcctgagattgggcgact

SEQ ID NO: 618 - DNA, 51 bp, Homo sapiens
  misc_feature (26)...(0): 2 of 2 allelic variants (617 is other entry)
  misc_feature (0)...(0): Accession number cg42312996
tcacctccttccctttattctaccggcccaagggcctgagattgggcgact

SEQ ID NO: 619 - DNA, 51 bp, Homo sapiens
  misc_feature (26)...(0): 1 of 2 allelic variants (620 is other entry)
  misc_feature (0)...(0): Accession number cg42322469
tcctaaaaccattagtatctactaaattgacgctgaaattttgtatttttg

SEQ ID NO: 620 - DNA, 51 bp, Homo sapiens
  misc_feature (26)...(0): 2 of 2 allelic variants (619 is other entry)
  misc_feature (0)...(0): Accession number cg42322469
tcctaaaaccattagtatctactaatttgacgctgaaattttgtatttttg

SEQ ID NO: 621 - DNA, 51 bp, Homo sapiens
  misc_feature (26)...(0): 1 of 2 allelic variants (622 is other entry)
  misc_feature (0)...(0): Accession number cg42327033
ggcttctcaggggtcaggtgcatttgggcagatgcgcttgagtgggggggc

SEQ ID NO: 622 - DNA, 51 bp, Homo sapiens
  misc_feature (26)...(0): 2 of 2 allelic variants (621 is other entry)
  misc_feature (0)...(0): Accession number cg42327033
ggcttctcaggggtcaggtgcattttggcagatgcgcttgagtgggggggc

SEQ ID NO: 623 - DNA, 51 bp, Homo sapiens
  misc_feature (26)...(0): 1 of 2 allelic variants (624 is other entry)
  misc_feature (0)...(0): Accession number cg42462046
ggccacagcgccctgccccagagaacggcgggtgggctgggtccggctgcg

SEQ ID NO: 624 - DNA, 51 bp, Homo sapiens
  misc_feature (26)...(0): 2 of 2 allelic variants (623 is other entry)
  misc_feature (0)...(0): Accession number cg42462046
ggccacagcgccctgccccagagaatggcgggtgggctgggtccggctgcg

SEQ ID NO: 625 - DNA, 51 bp, Homo sapiens
  misc_feature (26)...(0): 1 of 2 allelic variants (626 is other entry)
  misc_feature (0)...(0): Accession number cg42462046
cctgccgcgcgcggcggggctcctcctcgctgtgggaaaagtggggccaca

SEQ ID NO: 626 - DNA, 51 bp, Homo sapiens
  misc_feature (26)...(0): 2 of 2 allelic variants (625 is other entry)
  misc_feature (0)...(0): Accession number cg42462046
cctgccgcgcgcggcggggctcctcttcgctgtgggaaaagtggggccaca

SEQ ID NO: 627 - DNA, 51 bp, Homo sapiens
  misc_feature (26)...(0): 1 of 2 allelic variants (628 is other entry)
  misc_feature (0)...(0): Accession number cg42468895
gcctgggcaacagagcagcaagactgtctttacactcggggtgagtagtcg

SEQ ID NO: 628 - DNA, 50 bp, Homo sapiens
  misc_feature (26)...(0): 2 of 2 allelic variants (627 is other entry)
  misc_feature (25)...(26): nucleotide deleted between bases 25 and 26
  misc_feature (0)...(0): Accession number cg42468895
gcctgggcaacagagcagcaagacttctttacactcggggtgagtagtcg

SEQ ID NO: 629 - DNA, 51 bp, Homo sapiens
  misc_feature (26)...(0): 1 of 2 allelic variants (630 is other entry)
  misc_feature (0)...(0): Accession number cg42518152
gacacacatgcacacggtttcaccaccacggcttctctccagccttctctt

SEQ ID NO: 630 - DNA, 51 bp, Homo sapiens
  misc_feature (26)...(0): 2 of 2 allelic variants (629 is other entry)
  misc_feature (0)...(0): Accession number cg42518152
gacacacatgcacacggtttcaccagcacggcttctctccagccttctctt

SEQ ID NO: 631 - DNA, 51 bp, Homo sapiens
  misc_feature (26)...(0): 1 of 2 allelic variants (632 is other entry)
  misc_feature (0)...(0): Accession number cg42534385
gccgcctaccacaagtcggtgtggcggggggtggaggccaagctgcacctg

SEQ ID NO: 632 - DNA, 50 bp, Homo sapiens
  misc_feature (26)...(0): 2 of 2 allelic variants (631 is other entry)
  misc_feature (25)...(26): nucleotide deleted between bases 25 and 26
  misc_feature (0)...(0): Accession number cg42534385
gccgcctaccacaagtcggtgtggcgggggtggaggccaagctgcacctg

SEQ ID NO: 633 - DNA, 50 bp, Homo sapiens
  misc_feature (26)...(0): 1 of 2 allelic variants (634 is other entry)
  misc_feature (25)...(26): nucleotide deleted between bases 25 and 26
  misc_feature (0)...(0): Accession number cg42534385
taccacaagtcggtgtggcggggggtggaggccaagctgcacctgcgccg

SEQ ID NO: 634 - DNA, 51 bp, Homo sapiens
  misc_feature (26)...(0): 2 of 2 allelic variants (633 is other entry)
  misc_feature (0)...(0): Accession number cg42534385
taccacaagtcggtgtggcgggggggtggaggccaagctgcacctgcgccg

SEQ ID NO: 635 - DNA, 51 bp, Homo sapiens
  misc_feature (26)...(0): 1 of 2 allelic variants (636 is other entry)
  misc_feature (0)...(0): Accession number cg42560726
cgcctgtaatctcagcactctgggaagtcaaggcaggtggatcacttgagc

SEQ ID NO: 636 - DNA, 51 bp, Homo sapiens
  misc_feature (26)...(0): 2 of 2 allelic variants (635 is other entry)
  misc_feature (0)...(0): Accession number cg42560726
cgcctgtaatctcagcactctgggaggtcaaggcaggtggatcacttgagc

SEQ ID NO: 637 - DNA, 51 bp, Homo sapiens
  misc_feature (26)...(0): 1 of 2 allelic variants (638 is other entry)
  misc_feature (0)...(0): Accession number cg42656733
gggaccacgatggactgagccagctttgcccgcccgcccccgcgcccaggg

SEQ ID NO: 638 - DNA, 51 bp, Homo sapiens
  misc_feature (26)...(0): 2 of 2 allelic variants (637 is other entry)
  misc_feature (0)...(0): Accession number cg42656733
gggaccacgatggactgagccagctctgcccgcccgcccccgcgcccaggg

SEQ ID NO: 639 - DNA, 51 bp, Homo sapiens
  misc_feature (26)...(0): 1 of 2 allelic variants (640 is other entry)
  misc_feature (0)...(0): Accession number cg42658258
ggcctgcagactccgggcccagggccaccggcctctcctacctgctcctgc

SEQ ID NO: 640 - DNA, 50 bp, Homo sapiens
  misc_feature (26)...(0): 2 of 2 allelic variants (639 is other entry)
  misc_feature (25)...(26): nucleotide deleted between bases 25 and 26
  misc_feature (0)...(0): Accession number cg42658258
ggcctgcagactccgggcccagggcaccggcctctcctacctgctcctgc

SEQ ID NO: 641 - DNA, 51 bp, Homo sapiens
  misc_feature (26)...(0): 1 of 2 allelic variants (642 is other entry)
  misc_feature (0)...(0): Accession number cg42673467
atagaccaacaatcatgtatcctgccacttgggatgccagcacccatgcca

SEQ ID NO: 642 - DNA, 51 bp, Homo sapiens
  misc_feature (26)...(0): 2 of 2 allelic variants (641 is other entry)
  misc_feature (0)...(0): Accession number cg42673467
atagaccaacaatcatgtatcctgctacttgggatgccagcacccatgcca

SEQ ID NO: 643 - DNA, 51 bp, Homo sapiens
  misc_feature (26)...(0): 1 of 2 allelic variants (644 is other entry)
  misc_feature (0)...(0): Accession number cg42691712
ccgagcagtggccgcgtgcaggagtccagagtggagccgtgactcacaatt

SEQ ID NO: 644 - DNA, 51 bp, Homo sapiens
  misc_feature (26)...(0): 2 of 2 allelic variants (643 is other entry)
  misc_feature (0)...(0): Accession number cg42691712
ccgagcagtggccgcgtgcaggagtacagagtggagccgtgactcacaatt

SEQ ID NO: 645 - DNA, 51 bp, Homo sapiens
  misc_feature (26)...(0): 1 of 2 allelic variants (646 is other entry)
  misc_feature (0)...(0): Accession number cg42705180
ctttggcaaattggggactgaagacgggaagggtggagagtaggcggaacc

SEQ ID NO: 646 - DNA, 51 bp, Homo sapiens
  misc_feature (26)...(0): 2 of 2 allelic variants (645 is other entry)
  misc_feature (0)...(0): Accession number cg42705180
ctttggcaaattggggactgaagactggaagggtggagagtaggcggaacc

SEQ ID NO: 647 - DNA, 51 bp, Homo sapiens
  misc_feature (26)...(0): 1 of 2 allelic variants (648 is other entry)
  misc_feature (0)...(0): Accession number cg42705180
aaattggggactgaagacgggaagggtggagagtaggcggaaccaggtggt

SEQ ID NO: 648 - DNA, 51 bp, Homo sapiens
  misc_feature (26)...(0): 2 of 2 allelic variants (647 is other entry)
  misc_feature (0)...(0): Accession number cg42705180
aaattggggactgaagacgggaaggatggagagtaggcggaaccaggtggt

SEQ ID NO: 649 - DNA, 51 bp, Homo sapiens
  misc_feature (26)...(0): 1 of 2 allelic variants (650 is other entry)
  misc_feature (0)...(0): Accession number cg42718789
gaattcaacaacactatagagtcaaaaggaaacgagtcgagtgaaaccagt

SEQ ID NO: 650 - DNA, 51 bp, Homo sapiens
  misc_feature (26)...(0): 2 of 2 allelic variants (649 is other entry)
  misc_feature (0)...(0): Accession number cg42718789
gaattcaacaacactatagagtcaagaggaaacgagtcgagtgaaaccagt

SEQ ID NO: 651 - DNA, 51 bp, Homo sapiens
  misc_feature (26)...(0): 1 of 2 allelic variants (652 is other entry)
  misc_feature (0)...(0): Accession number cg42719781
gattctgattttagtgatgatgaacgctgtggagaatccagcaaaaggaaa

SEQ ID NO: 652 - DNA, 51 bp, Homo sapiens
  misc_feature (26)...(0): 2 of 2 allelic variants (651 is other entry)
  misc_feature (0)...(0): Accession number cg42719781
gattctgattttagtgatgatgaacactgtggagaatccagcaaaaggaaa

SEQ ID NO: 653 - DNA, 51 bp, Homo sapiens
  misc_feature (26)...(0): 1 of 2 allelic variants (654 is other entry)
  misc_feature (0)...(0): Accession number cg42848362
catgcaggcgcgcctgtagtcccagctactcgggaggctgacgcaggagaa

SEQ ID NO: 654 - DNA, 51 bp, Homo sapiens
  misc_feature (26)...(0): 2 of 2 allelic variants (653 is other entry)
  misc_feature (0)...(0): Accession number cg42848362
catgcaggcgcgcctgtagtcccagttactcgggaggctgacgcaggagaa

SEQ ID NO: 655 - DNA, 51 bp, Homo sapiens
  misc_feature (26)...(0): 1 of 2 allelic variants (656 is other entry)
  misc_feature (0)...(0): Accession number cg42848627
tcctccatcaccaggctgtctaacgaggctgaagaagtaccatccatgagt

SEQ ID NO: 656 - DNA, 51 bp, Homo sapiens
  misc_feature (26)...(0): 2 of 2 allelic variants (655 is other entry)
  misc_feature (0)...(0): Accession number cg42848627
tcctccatcaccaggctgtctaacggggctgaagaagtaccatccatgagt

SEQ ID NO: 657 - DNA, 51 bp, Homo sapiens
  misc_feature (26)...(0): 1 of 2 allelic variants (658 is other entry)
  misc_feature (0)...(0): Accession number cg42895723
cagggtgccaggcacttctttaatgtgttctttctttatgtgattatttga

SEQ ID NO: 658 - DNA, 51 bp, Homo sapiens
  misc_feature (26)...(0): 2 of 2 allelic variants (657 is other entry)
  misc_feature (0)...(0): Accession number cg42895723
cagggtgccaggcacttctttaatgggttctttctttatgtgattatttga

SEQ ID NO: 659 - DNA, 51 bp, Homo sapiens
  misc_feature (26)...(0): 1 of 2 allelic variants (660 is other entry)
  misc_feature (0)...(0): Accession number cg42910590
gcccgggacgagggagaatctgcagtagctgaggaccccacatggggtgag

SEQ ID NO: 660 - DNA, 51 bp, Homo sapiens
  misc_feature (26)...(0): 2 of 2 allelic variants (659 is other entry)
  misc_feature (0)...(0): Accession number cg42910590
gcccgggacgagggagaatctgcagcagctgaggaccccacatggggtgag

SEQ ID NO: 661 - DNA, 51 bp, Homo sapiens
  misc_feature (26)...(0): 1 of 2 allelic variants (662 is other entry)
  misc_feature (0)...(0): Accession number cg42913480
atgtggggaaaagcaagagagatcaaattgttactgtgtctgtgtagaaag

SEQ ID NO: 662 - DNA, 51 bp, Homo sapiens
  misc_feature (26)...(0): 2 of 2 allelic variants (661 is other entry)
  misc_feature (0)...(0): Accession number cg42913480
atgtggggaaaagcaagagagatcagattgttactgtgtctgtgtagaaag

SEQ ID NO: 663 - DNA, 51 bp, Homo sapiens
  misc_feature (26)...(0): 1 of 2 allelic variants (664 is other entry)
  misc_feature (0)...(0): Accession number cg42919036
gaggcagatgattcccaagagaactcaccaaatcaagacaaatgtcctaga

SEQ ID NO: 664 - DNA, 51 bp, Homo sapiens
  misc_feature (26)...(0): 2 of 2 allelic variants (663 is other entry)
  misc_feature (0)...(0): Accession number cg42919036
gaggcagatgattcccaagagaacttaccaaatcaagacaaatgtcctaga

SEQ ID NO: 665 - DNA, 51 bp, Homo sapiens
  misc_feature (26)...(0): 1 of 2 allelic variants (666 is other entry)
  misc_feature (0)...(0): Accession number cg42919304
gaggaaggcaaacagaaaggcaagggcagcaaacctttaatgcctacctcc

SEQ ID NO: 666 - DNA, 51 bp, Homo sapiens
  misc_feature (26)...(0): 2 of 2 allelic variants (665 is other entry)
  misc_feature (0)...(0): Accession number cg42919304
gaggaaggcaaacagaaaggcaaggacagcaaacctttaatgcctacctcc

SEQ ID NO: 667 - DNA, 51 bp, Homo sapiens
  misc_feature (26)...(0): 1 of 2 allelic variants (668 is other entry)
  misc_feature (0)...(0): Accession number cg42922781
gaggcgggttagtgcccatggatccggtgtctgggaaggggcccacagaag

SEQ ID NO: 668 - DNA, 51 bp, Homo sapiens
  misc_feature (26)...(0): 2 of 2 allelic variants (667 is other entry)
  misc_feature (0)...(0): Accession number cg42922781
gaggcgggttagtgcccatggatccagtgtctgggaaggggcccacagaag

SEQ ID NO: 669 - DNA, 51 bp, Homo sapiens
  misc_feature (26)...(0): 1 of 2 allelic variants (670 is other entry)
  misc_feature (0)...(0): Accession number cg42924993
ttttaggccaggtgcagtggctcacacccttaatcccagcactttgggagg

SEQ ID NO: 670 - DNA, 51 bp, Homo sapiens
  misc_feature (26)...(0): 2 of 2 allelic variants (669 is other entry)
  misc_feature (0)...(0): Accession number cg42924993
ttttaggccaggtgcagtggctcacgcccttaatcccagcactttgggagg

SEQ ID NO: 671 - DNA, 51 bp, Homo sapiens
  misc_feature (26)...(0): 1 of 2 allelic variants (672 is other entry)
  misc_feature (0)...(0): Accession number cg42924993
agaccagcctggccaacatggtgaaaccccgtctctactaaaaatacaaaa

SEQ ID NO: 672 - DNA, 51 bp, Homo sapiens
  misc_feature (26)...(0): 2 of 2 allelic variants (671 is other entry)
  misc_feature (0)...(0): Accession number cg42924993
agaccagcctggccaacatggtgaagccccgtctctactaaaaatacaaaa

SEQ ID NO: 673 - DNA, 51 bp, Homo sapiens
  misc_feature (26)...(0): 1 of 2 allelic variants (674 is other entry)
  misc_feature (0)...(0): Accession number cg42925336
tcatgaggaaggccaggacaagtgtggcagagcggcttacccccatggcac

SEQ ID NO: 674 - DNA, 51 bp, Homo sapiens
  misc_feature (26)...(0): 2 of 2 allelic variants (673 is other entry)
  misc_feature (0)...(0): Accession number cg42925336
tcatgaggaaggccaggacaagtgttgcagagcggcttacccccatggcac

SEQ ID NO: 675 - DNA, 41 bp, Homo sapiens
  misc_feature (16)...(0): 1 of 2 allelic variants (676 is other entry)
  misc_feature (0)...(0): Accession number cg42943021
gcgcgccaggacgcccggctgttttgtatttttagtagaga

SEQ ID NO: 676 - DNA, 41 bp, Homo sapiens
  misc_feature (16)...(0): 2 of 2 allelic variants (675 is other entry)
  misc_feature (0)...(0): Accession number cg42943021
gcgcgccaggacgcctggctgttttgtatttttagtagaga

SEQ ID NO: 677 - DNA, 48 bp, Homo sapiens
  misc_feature (23)...(0): 1 of 2 allelic variants (678 is other entry)
  misc_feature (0)...(0): Accession number cg42943021
gcgcgccaggacgcccggctgttttgtatttttagtagagacagggtt

SEQ ID NO: 678 - DNA, 48 bp, Homo sapiens
  misc_feature (23)...(0): 2 of 2 allelic variants (677 is other entry)
  misc_feature (0)...(0): Accession number cg42943021
gcgcgccaggacgcccggctgtcttgtatttttagtagagacagggtt

SEQ ID NO: 679 - DNA, 51 bp, Homo sapiens
  misc_feature (26)...(0): 1 of 2 allelic variants (680 is other entry)
  misc_feature (0)...(0): Accession number cg42943021
cgcgccaggacgcccggctgttttgtatttttagtagagacagggttttga

SEQ ID NO: 680 - DNA, 51 bp, Homo sapiens
  misc_feature (26)...(0): 2 of 2 allelic variants (679 is other entry)
  misc_feature (0)...(0): Accession number cg42943021
cgcgccaggacgcccggctgttttgcatttttagtagagacagggttttga

SEQ ID NO: 681 - DNA, 51 bp, Homo sapiens
  misc_feature (26)...(0): 1 of 2 allelic variants (682 is other entry)
  misc_feature (0)...(0): Accession number cg42943021
agggttttgagtgatctgtccaccttagcctcccaaagtgctgggattaca

SEQ ID NO: 682 - DNA, 51 bp, Homo sapiens
  misc_feature (26)...(0): 2 of 2 allelic variants (681 is other entry)
  misc_feature (0)...(0): Accession number cg42943021
agggttttgagtgatctgtccacctcagcctcccaaagtgctgggattaca

SEQ ID NO: 683 - DNA, 51 bp, Homo sapiens
  misc_feature (26)...(0): 1 of 2 allelic variants (684 is other entry)
  misc_feature (0)...(0): Accession number cg42943021
ccttagcctcccaaagtgctgggattacaggcatgagccactgtgccccgc

SEQ ID NO: 684 - DNA, 51 bp, Homo sapiens
  misc_feature (26)...(0): 2 of 2 allelic variants (683 is other entry)
  misc_feature (0)...(0): Accession number cg42943021
ccttagcctcccaaagtgctgggatcacaggcatgagccactgtgccccgc

SEQ ID NO: 685 - DNA, 51 bp, Homo sapiens
  misc_feature (26)...(0): 1 of 2 allelic variants (686 is other entry)
  misc_feature (0)...(0): Accession number cg43008177
acatcaaattagcaattaccatagacatgtatttcattgaataaatagctt

SEQ ID NO: 686 - DNA, 51 bp, Homo sapiens
  misc_feature (26)...(0): 2 of 2 allelic variants (685 is other entry)
  misc_feature (0)...(0): Accession number cg43008177
acatcaaattagcaattaccatagaaatgtatttcattgaataaatagctt

SEQ ID NO: 687 - DNA, 50 bp, Homo sapiens
  misc_feature (26)...(0): 1 of 2 allelic variants (688 is other entry)
  misc_feature (25)...(26): nucleotide deleted between bases 25 and 26
  misc_feature (0)...(0): Accession number cg43008177
cttttgtttgtttgtttgtttgtttcagggaaatttagaacaattattag

SEQ ID NO: 688 - DNA, 51 bp, Homo sapiens
  misc_feature (26)...(0): 2 of 2 allelic variants (687 is other entry)
  misc_feature (0)...(0): Accession number cg43008177
cttttgtttgtttgtttgtttgtttgcagggaaatttagaacaattattag

SEQ ID NO: 689 - DNA, 51 bp, Homo sapiens
  misc_feature (26)...(0): 1 of 2 allelic variants (690 is other entry)
  misc_feature (0)...(0): Accession number cg43008177
atttagaacaattattagatgttatagtgcctcttctcgtgttgatacgtg

SEQ ID NO: 690 - DNA, 51 bp, Homo sapiens
  misc_feature (26)...(0): 2 of 2 allelic variants (689 is other entry)
  misc_feature (0)...(0): Accession number cg43008177
atttagaacaattattagatgttattgtgcctcttctcgtgttgatacgtg

SEQ ID NO: 691 - DNA, 51 bp, Homo sapiens
  misc_feature (26)...(0): 1 of 2 allelic variants (692 is other entry)
  misc_feature (0)...(0): Accession number cg43040173
gggaaaccccaggggaggcggaggccagcggggatttctgaagccaagtgg

SEQ ID NO: 692 - DNA, 50 bp, Homo sapiens
  misc_feature (26)...(0): 2 of 2 allelic variants (691 is other entry)
  misc_feature (25)...(26): nucleotide deleted between bases 25 and 26
  misc_feature (0)...(0): Accession number cg43040173
gggaaaccccaggggaggcggaggcagcggggatttctgaagccaagtgg

SEQ ID NO: 693 - DNA, 51 bp, Homo sapiens
  misc_feature (26)...(0): 1 of 2 allelic variants (694 is other entry)
  misc_feature (0)...(0): Accession number cg43054295
gaggctggcgggctagggctgagtgcagcgcctgcttagagaccttcggga

SEQ ID NO: 694 - DNA, 51 bp, Homo sapiens
  misc_feature (26)...(0): 2 of 2 allelic variants (693 is other entry)
  misc_feature (0)...(0): Accession number cg43054295
gaggctggcgggctagggctgagtggagcgcctgcttagagaccttcggga

SEQ ID NO: 695 - DNA, 51 bp, Homo sapiens
  misc_feature (26)...(0): 1 of 2 allelic variants (696 is other entry)
  misc_feature (0)...(0): Accession number cg43054295
tagagaccttcgggagaacttctgccggaaccccgacggctcagaggcgcc

SEQ ID NO: 696 - DNA, 51 bp, Homo sapiens
  misc_feature (26)...(0): 2 of 2 allelic variants (695 is other entry)
  misc_feature (0)...(0): Accession number cg43054295
tagagaccttcgggagaacttctgctggaaccccgacggctcagaggcgcc

SEQ ID NO: 697 - DNA, 51 bp, Homo sapiens
  misc_feature (26)...(0): 1 of 2 allelic variants (698 is other entry)
  misc_feature (0)...(0): Accession number cg43054295
gctcagaggcgccctggtgcttcacactgcggcccggcacgcgcgtgggct

SEQ ID NO: 698 - DNA, 51 bp, Homo sapiens
  misc_feature (26)...(0): 2 of 2 allelic variants (697 is other entry)
  misc_feature (0)...(0): Accession number cg43054295
gctcagaggcgccctggtgcttcaccctgcggcccggcacgcgcgtgggct

SEQ ID NO: 699 - DNA, 51 bp, Homo sapiens
  misc_feature (26)...(0): 1 of 2 allelic variants (700 is other entry)
  misc_feature (0)...(0): Accession number cg43060167
ttgccccccgccaacctactcaaccccttccagataaagacagtgggcact

SEQ ID NO: 700 - DNA, 51 bp, Homo sapiens
  misc_feature (26)...(0): 2 of 2 allelic variants (699 is other entry)
  misc_feature (0)...(0): Accession number cg43060167
ttgccccccgccaacctactcaacctcttccagataaagacagtgggcact

SEQ ID NO: 701 - DNA, 51 bp, Homo sapiens
  misc_feature (26)...(0): 1 of 2 allelic variants (702 is other entry)
  misc_feature (0)...(0): Accession number cg43076634
gcgcgcctaccacgtcaagctaattttttgtattttagtagaggtggggtt

SEQ ID NO: 702 - DNA, 51 bp, Homo sapiens
  misc_feature (26)...(0): 2 of 2 allelic variants (701 is other entry)
  misc_feature (0)...(0): Accession number cg43076634
gcgcgcctaccacgtcaagctaattgtttgtattttagtagaggtggggtt

SEQ ID NO: 703 - DNA, 51 bp, Homo sapiens
  misc_feature (26)...(0): 1 of 2 allelic variants (704 is other entry)
  misc_feature (0)...(0): Accession number cg43089031
aaatgggccaggcgcggtgactcacacctataatcccagcactttgggagg

SEQ ID NO: 704 - DNA, 51 bp, Homo sapiens
  misc_feature (26)...(0): 2 of 2 allelic variants (703 is other entry)
  misc_feature (0)...(0): Accession number cg43089031
aaatgggccaggcgcggtgactcacgcctataatcccagcactttgggagg

SEQ ID NO: 705 - DNA, 51 bp, Homo sapiens
  misc_feature (26)...(0): 1 of 2 allelic variants (706 is other entry)
  misc_feature (0)...(0): Accession number cg43089031
tttgggaggccgaggagggtggatcacctgaggtcaggaattccagaccag

SEQ ID NO: 706 - DNA, 51 bp, Homo sapiens
  misc_feature (26)...(0): 2 of 2 allelic variants (705 is other entry)
  misc_feature (0)...(0): Accession number cg43089031
tttgggaggccgaggagggtggatcgcctgaggtcaggaattccagaccag

SEQ ID NO: 707 - DNA, 51 bp, Homo sapiens
  misc_feature (26)...(0): 1 of 2 allelic variants (708 is other entry)
  misc_feature (0)...(0): Accession number cg43149120
ccaagaagacgctggagggaggctgttaggagggactctgagcttcacacc

SEQ ID NO: 708 - DNA, 51 bp, Homo sapiens
  misc_feature (26)...(0): 2 of 2 allelic variants (707 is other entry)
  misc_feature (0)...(0): Accession number cg43149120
ccaagaagacgctggagggaggctgctaggagggactctgagcttcacacc

SEQ ID NO: 709 - DNA, 51 bp, Homo sapiens
  misc_feature (26)...(0): 1 of 2 allelic variants (710 is other entry)
  misc_feature (0)...(0): Accession number cg43256880
gggaatcttctctttgacgtatgggaagcctcagaaagacattttcctaat

SEQ ID NO: 710 - DNA, 51 bp, Homo sapiens
  misc_feature (26)...(0): 2 of 2 allelic variants (709 is other entry)
  misc_feature (0)...(0): Accession number cg43256880
gggaatcttctctttgacgtatggggagcctcagaaagacattttcctaat

SEQ ID NO: 711 - DNA, 51 bp, Homo sapiens
  misc_feature (26)...(0): 1 of 2 allelic variants (712 is other entry)
  misc_feature (0)...(0): Accession number cg43256880
gaatggccctatgatgtttccttcgaaactggtactgctcagccctgatca

SEQ ID NO: 712 - DNA, 51 bp, Homo sapiens
  misc_feature (26)...(0): 2 of 2 allelic variants (711 is other entry)
  misc_feature (0)...(0): Accession number cg43256880
gaatggccctatgatgtttccttcggaactggtactgctcagccctgatca

SEQ ID NO: 713 - DNA, 51 bp, Homo sapiens
  misc_feature (26)...(0): 1 of 2 allelic variants (714 is other entry)
  misc_feature (0)...(0): Accession number cg43261262
gtgtttggatttgatcatggatgtagcatacaccaaaatccaccgagacct

SEQ ID NO: 714 - DNA, 51 bp, Homo sapiens
  misc_feature (26)...(0): 2 of 2 allelic variants (713 is other entry)
  misc_feature (0)...(0): Accession number cg43261262
gtgtttggatttgatcatggatgtaacatacaccaaaatccaccgagacct

SEQ ID NO: 715 - DNA, 51 bp, Homo sapiens
  misc_feature (26)...(0): 1 of 2 allelic variants (716 is other entry)
  misc_feature (0)...(0): Accession number cg43276309
ttggcttggggggtccacagtgaggcagatgctgggcgtgaagaatctgct

SEQ ID NO: 716 - DNA, 51 bp, Homo sapiens
  misc_feature (26)...(0): 2 of 2 allelic variants (715 is other entry)
  misc_feature (0)...(0): Accession number cg43276309
ttggcttggggggtccacagtgaggtagatgctgggcgtgaagaatctgct

SEQ ID NO: 717 - DNA, 51 bp, Homo sapiens
  misc_feature (26)...(0): 1 of 2 allelic variants (718 is other entry)
  misc_feature (0)...(0): Accession number cg43276309
ggcctggaggggccaccaagatgcaggagctgggcctggagaggctgcaaa

SEQ ID NO: 718 - DNA, 51 bp, Homo sapiens
  misc_feature (26)...(0): 2 of 2 allelic variants (717 is other entry)
  misc_feature (0)...(0): Accession number cg43276309
ggcctggaggggccaccaagatgcatgagctgggcctggagaggctgcaaa

SEQ ID NO: 719 - DNA, 51 bp, Homo sapiens
  misc_feature (26)...(0): 1 of 2 allelic variants (720 is other entry)
  misc_feature (0)...(0): Accession number cg43276380
gtccactgtgaggcagaggctgggcgtgaagaatctgctgtgaggcagatg

SEQ ID NO: 720 - DNA, 51 bp, Homo sapiens
  misc_feature (26)...(0): 2 of 2 allelic variants (719 is other entry)
  misc_feature (0)...(0): Accession number cg43276380
gtccactgtgaggcagaggctgggcctgaagaatctgctgtgaggcagatg

SEQ ID NO: 721 - DNA, 51 bp, Homo sapiens
  misc_feature (26)...(0): 1 of 2 allelic variants (722 is other entry)
  misc_feature (0)...(0): Accession number cg43304080
gccgggcagagtggagcagcttggggccgtgcccagggcggtggctgtgag

SEQ ID NO: 722 - DNA, 51 bp, Homo sapiens
  misc_feature (26)...(0): 2 of 2 allelic variants (721 is other entry)
  misc_feature (0)...(0): Accession number cg43304080
gccgggcagagtggagcagcttgggaccgtgcccagggcggtggctgtgag

SEQ ID NO: 723 - DNA, 51 bp, Homo sapiens
  misc_feature (26)...(0): 1 of 2 allelic variants (724 is other entry)
  misc_feature (0)...(0): Accession number cg43323676
ggtgtggtgtggattgtagcttcccgaaactcatggcgcctcccctcggac

SEQ ID NO: 724 - DNA, 51 bp, Homo sapiens
  misc_feature (26)...(0): 2 of 2 allelic variants (723 is other entry)
  misc_feature (0)...(0): Accession number cg43323676
ggtgtggtgtggattgtagcttcccaaaactcatggcgcctcccctcggac

SEQ ID NO: 725 - DNA, 51 bp, Homo sapiens
  misc_feature (26)...(0): 1 of 2 allelic variants (726 is other entry)
  misc_feature (0)...(0): Accession number cg43326623
ggataaccagaattatcacagcaccctctcattcccagcgcgtccttctga

SEQ ID NO: 726 - DNA, 51 bp, Homo sapiens
  misc_feature (26)...(0): 2 of 2 allelic variants (725 is other entry)
  misc_feature (0)...(0): Accession number cg43326623
ggataaccagaattatcacagcaccttctcattcccagcgcgtccttctga

SEQ ID NO: 727 - DNA, 51 bp, Homo sapiens
  misc_feature (26)...(0): 1 of 2 allelic variants (728 is other entry)
  misc_feature (0)...(0): Accession number cg43328092
ttgctgtgtaagaataggtccctcaacatgaagatgtgtctgcgtctgagc

SEQ ID NO: 728 - DNA, 51 bp, Homo sapiens
  misc_feature (26)...(0): 2 of 2 allelic variants (727 is other entry)
  misc_feature (0)...(0): Accession number cg43328092
ttgctgtgtaagaataggtccctcagcatgaagatgtgtctgcgtctgagc

SEQ ID NO: 729 - DNA, 51 bp, Homo sapiens
  misc_feature (26)...(0): 1 of 2 allelic variants (730 is other entry)
  misc_feature (0)...(0): Accession number cg43328259
agccttcagggagcgtggagacaggctttgaagacaagattcccaaaagga

SEQ ID NO: 730 - DNA, 51 bp, Homo sapiens
  misc_feature (26)...(0): 2 of 2 allelic variants (729 is other entry)
  misc_feature (0)...(0): Accession number cg43328259
agccttcagggagcgtggagacaggttttgaagacaagattcccaaaagga

SEQ ID NO: 731 - DNA, 51 bp, Homo sapiens
  misc_feature (26)...(0): 1 of 2 allelic variants (732 is other entry)
  misc_feature (0)...(0): Accession number cg43328259
acggccatggagactgcaattccattcagatcacgtttcttcaatctgaag

SEQ ID NO: 732 - DNA, 51 bp, Homo sapiens
  misc_feature (26)...(0): 2 of 2 allelic variants (731 is other entry)
  misc_feature (0)...(0): Accession number cg43328259
acggccatggagactgcaattccatccagatcacgtttcttcaatctgaag

SEQ ID NO: 733 - DNA, 51 bp, Homo sapiens
  misc_feature (26)...(0): 1 of 2 allelic variants (734 is other entry)
  misc_feature (0)...(0): Accession number cg43336005
gatgtttggctgcacgcgagcccactcgggacagacccaagaacacgaatt

SEQ ID NO: 734 - DNA, 51 bp, Homo sapiens
  misc_feature (26)...(0): 2 of 2 allelic variants (733 is other entry)
  misc_feature (0)...(0): Accession number cg43336005
gatgtttggctgcacgcgagcccacgcgggacagacccaagaacacgaatt

SEQ ID NO: 735 - DNA, 51 bp, Homo sapiens
  misc_feature (26)...(0): 1 of 2 allelic variants (736 is other entry)
  misc_feature (0)...(0): Accession number cg43916688
gcggcgagagcggctcctctgcgcagccggcgccggctccgcttccccttc

SEQ ID NO: 736 - DNA, 50 bp, Homo sapiens
  misc_feature (26)...(0): 2 of 2 allelic variants (735 is other entry)
  misc_feature (25)...(26): nucleotide deleted between bases 25 and 26
  misc_feature (0)...(0): Accession number cg43916688
gcggcgagagcggctcctctgcgcaccggcgccggctccgcttccccttc

SEQ ID NO: 737 - DNA, 51 bp, Homo sapiens
  misc_feature (26)...(0): 1 of 2 allelic variants (738 is other entry)
  misc_feature (0)...(0): Accession number cg43917746
tggatagaagtgcttcactaattgctttatttaagcatacaagaaaaaaag

SEQ ID NO: 738 - DNA, 51 bp, Homo sapiens
  misc_feature (26)...(0): 2 of 2 allelic variants (737 is other entry)
  misc_feature (0)...(0): Accession number cg43917746
tggatagaagtgcttcactaattgccttatttaagcatacaagaaaaaaag

SEQ ID NO: 739 - DNA, 51 bp, Homo sapiens
  misc_feature (26)...(0): 1 of 2 allelic variants (740 is other entry)
  misc_feature (0)...(0): Accession number cg43917746
caagcatggcccagccagcaccaccacccccaaaacgaacaaaacaagaga

SEQ ID NO: 740 - DNA, 51 bp, Homo sapiens
  misc_feature (26)...(0): 2 of 2 allelic variants (739 is other entry)
  misc_feature (0)...(0): Accession number cg43917746
caagcatggcccagccagcaccaccgcccccaaaacgaacaaaacaagaga

SEQ ID NO: 741 - DNA, 51 bp, Homo sapiens
  misc_feature (26)...(0): 1 of 2 allelic variants (742 is other entry)
  misc_feature (0)...(0): Accession number cg43918370
tcaccaggaaagcctgcctcctccgaggacctgcccgcctccgggagcagc

SEQ ID NO: 742 - DNA, 51 bp, Homo sapiens
  misc_feature (26)...(0): 2 of 2 allelic variants (741 is other entry)
  misc_feature (0)...(0): Accession number cg43918370
tcaccaggaaagcctgcctcctccggggacctgcccgcctccgggagcagc

SEQ ID NO: 743 - DNA, 51 bp, Homo sapiens
  misc_feature (26)...(0): 1 of 2 allelic variants (744 is other entry)
  misc_feature (0)...(0): Accession number cg43919788
agggacatagaaccaagccccagggctgcccagctacacgaccgccgctgg

SEQ ID NO: 744 - DNA, 51 bp, Homo sapiens
  misc_feature (26)...(0): 2 of 2 allelic variants (743 is other entry)
  misc_feature (0)...(0): Accession number cg43919788
agggacatagaaccaagccccaggggtgcccagctacacgaccgccgctgg

SEQ ID NO: 745 - DNA, 51 bp, Homo sapiens
  misc_feature (26)...(0): 1 of 2 allelic variants (746 is other entry)
  misc_feature (0)...(0): Accession number cg43919798
actcaccttattcttcatttcccctcgtgaatcctccaggcctttctctac

SEQ ID NO: 746 - DNA, 51 bp, Homo sapiens
  misc_feature (26)...(0): 2 of 2 allelic variants (745 is other entry)
  misc_feature (0)...(0): Accession number cg43919798
actcaccttattcttcatttcccctggtgaatcctccaggcctttctctac

SEQ ID NO: 747 - DNA, 51 bp, Homo sapiens
  misc_feature (26)...(0): 1 of 2 allelic variants (748 is other entry)
  misc_feature (0)...(0): Accession number cg43921083
caggccggtgaccccccatggagcctcacatggcgaagaggatgaggaagg

SEQ ID NO: 748 - DNA, 51 bp, Homo sapiens
  misc_feature (26)...(0): 2 of 2 allelic variants (747 is other entry)
  misc_feature (0)...(0): Accession number cg43921083
caggccggtgaccccccatggagccccacatggcgaagaggatgaggaagg

SEQ ID NO: 749 - DNA, 50 bp, Homo sapiens
  misc_feature (26)...(0): 1 of 2 allelic variants (750 is other entry)
  misc_feature (25)...(26): nucleotide deleted between bases 25 and 26
  misc_feature (0)...(0): Accession number cg43921103
cagggagacgccagcattaaaaaaagagagatgtgtttattccatgatca

SEQ ID NO: 750 - DNA, 51 bp, Homo sapiens
  misc_feature (26)...(0): 2 of 2 allelic variants (749 is other entry)
  misc_feature (0)...(0): Accession number cg43921103
cagggagacgccagcattaaaaaaaagagagatgtgtttattccatgatca

SEQ ID NO: 751 - DNA, 51 bp, Homo sapiens
  misc_feature (26)...(0): 1 of 2 allelic variants (752 is other entry)
  misc_feature (0)...(0): Accession number cg43921107
gggtgctggccttcctggcctcggccttcttcttggtggtcgacgcgtatt

SEQ ID NO: 752 - DNA, 51 bp, Homo sapiens
  misc_feature (26)...(0): 2 of 2 allelic variants (751 is other entry)
  misc_feature (0)...(0): Accession number cg43921107
gggtgctggccttcctggcctcggctttcttcttggtggtcgacgcgtatt

SEQ ID NO: 753 - DNA, 51 bp, Homo sapiens
  misc_feature (26)...(0): 1 of 2 allelic variants (754 is other entry)
  misc_feature (0)...(0): Accession number cg43921619
agagctggaggaggtatttgtgaaggagcagggagaagaggagctgctgag

SEQ ID NO: 754 - DNA, 51 bp, Homo sapiens
  misc_feature (26)...(0): 2 of 2 allelic variants (753 is other entry)
  misc_feature (0)...(0): Accession number cg43921619
agagctggaggaggtatttgtgaagtagcagggagaagaggagctgctgag

SEQ ID NO: 755 - DNA, 51 bp, Homo sapiens
  misc_feature (26)...(0): 1 of 2 allelic variants (756 is other entry)
  misc_feature (0)...(0): Accession number cg43925523
ggattcttggctgaagaattcctctggaaatatttcccaggccaaaggtgg

SEQ ID NO: 756 - DNA, 51 bp, Homo sapiens
  misc_feature (26)...(0): 2 of 2 allelic variants (755 is other entry)
  misc_feature (0)...(0): Accession number cg43925523
ggattcttggctgaagaattcctctagaaatatttcccaggccaaaggtgg

SEQ ID NO: 757 - DNA, 51 bp, Homo sapiens
  misc_feature (26)...(0): 1 of 2 allelic variants (758 is other entry)
  misc_feature (0)...(0): Accession number cg43926586
acaccatgctggccgtggtgcgaaagcctcccgagtccatacagataccac

SEQ ID NO: 758 - DNA, 50 bp, Homo sapiens
  misc_feature (26)...(0): 2 of 2 allelic variants (757 is other entry)
  misc_feature (25)...(26): nucleotide deleted between bases 25 and 26
  misc_feature (0)...(0): Accession number cg43926586
acaccatgctggccgtggtgcgaaacctcccgagtccatacagataccac

SEQ ID NO: 759 - DNA, 51 bp, Homo sapiens
  misc_feature (26)...(0): 1 of 2 allelic variants (760 is other entry)
  misc_feature (0)...(0): Accession number cg43926872
ttctgcggccgcatcctgagcatggtgaacacagatgatgtcaacgccatc

SEQ ID NO: 760 - DNA, 51 bp, Homo sapiens
  misc_feature (26)...(0): 2 of 2 allelic variants (759 is other entry)
  misc_feature (0)...(0): Accession number cg43926872
ttctgcggccgcatcctgagcatggggaacacagatgatgtcaacgccatc

SEQ ID NO: 761 - DNA, 51 bp, Homo sapiens
  misc_feature (26)...(0): 1 of 2 allelic variants (762 is other entry)
  misc_feature (0)...(0): Accession number cg43927587
gcgggatgtttcttgggggcagctcgggtggagacacgacactttctactg

SEQ ID NO: 762 - DNA, 51 bp, Homo sapiens
  misc_feature (26)...(0): 2 of 2 allelic variants (761 is other entry)
  misc_feature (0)...(0): Accession number cg43927587
gcgggatgtttcttgggggcagctcaggtggagacacgacactttctactg

SEQ ID NO: 763 - DNA, 51 bp, Homo sapiens
  misc_feature (26)...(0): 1 of 2 allelic variants (764 is other entry)
  misc_feature (0)...(0): Accession number cg43927587
cttcctccagcggcacagggtattgcagatgggtcaccagccccatgtttt

SEQ ID NO: 764 - DNA, 51 bp, Homo sapiens
  misc_feature (26)...(0): 2 of 2 allelic variants (763 is other entry)
  misc_feature (0)...(0): Accession number cg43927587
cttcctccagcggcacagggtattgtagatgggtcaccagccccatgtttt

SEQ ID NO: 765 - DNA, 51 bp, Homo sapiens
  misc_feature (26)...(0): 1 of 2 allelic variants (766 is other entry)
  misc_feature (0)...(0): Accession number cg43927733
ctacacaggaagctggaaagatgacaagatgaatggttttggaagacttga

SEQ ID NO: 766 - DNA, 51 bp, Homo sapiens
  misc_feature (26)...(0): 2 of 2 allelic variants (765 is other entry)
  misc_feature (0)...(0): Accession number cg43927733
ctacacaggaagctggaaagatgacgagatgaatggttttggaagacttga

SEQ ID NO: 767 - DNA, 51 bp, Homo sapiens
  misc_feature (26)...(0): 1 of 2 allelic variants (768 is other entry)
  misc_feature (0)...(0): Accession number cg43927893
agcattggtgccctcatggctcatgtggacgcagtaatccgccactgtgca

SEQ ID NO: 768 - DNA, 51 bp, Homo sapiens
  misc_feature (26)...(0): 2 of 2 allelic variants (767 is other entry)
  misc_feature (0)...(0): Accession number cg43927893
agcattggtgccctcatggctcatgcggacgcagtaatccgccactgtgca

SEQ ID NO: 769 - DNA, 51 bp, Homo sapiens
  misc_feature (26)...(0): 1 of 2 allelic variants (770 is other entry)
  misc_feature (0)...(0): Accession number cg43927893
gccaacatcgagccactctttgaccggttgctcattttctggtctgaccgg

SEQ ID NO: 770 - DNA, 51 bp, Homo sapiens
  misc_feature (26)...(0): 2 of 2 allelic variants (769 is other entry)
  misc_feature (0)...(0): Accession number cg43927893
gccaacatcgagccactctttgaccagttgctcattttctggtctgaccgg

SEQ ID NO: 771 - DNA, 51 bp, Homo sapiens
  misc_feature (26)...(0): 1 of 2 allelic variants (772 is other entry)
  misc_feature (0)...(0): Accession number cg43929036
tgggcagccgaccccttgcagcgctggccagcggccgccaccaccacaccg

SEQ ID NO: 772 - DNA, 50 bp, Homo sapiens
  misc_feature (26)...(0): 2 of 2 allelic variants (771 is other entry)
  misc_feature (25)...(26): nucleotide deleted between bases 25 and 26
  misc_feature (0)...(0): Accession number cg43929036
tgggcagccgaccccttgcagcgctgccagcggccgccaccaccacaccg

SEQ ID NO: 773 - DNA, 51 bp, Homo sapiens
  misc_feature (26)...(0): 1 of 2 allelic variants (774 is other entry)
  misc_feature (0)...(0): Accession number cg43929036
gggcagccgaccccttgcagcgctggccagcggccgccaccaccacaccgc

SEQ ID NO: 774 - DNA, 50 bp, Homo sapiens
  misc_feature (26)...(0): 2 of 2 allelic variants (773 is other entry)
  misc_feature (25)...(26): nucleotide deleted between bases 25 and 26
  misc_feature (0)...(0): Accession number cg43929036
gggcagccgaccccttgcagcgctgccagcggccgccaccaccacaccgc

SEQ ID NO: 775 - DNA, 51 bp, Homo sapiens
  misc_feature (26)...(0): 1 of 2 allelic variants (776 is other entry)
  misc_feature (0)...(0): Accession number cg43929139
taatctgttcaacccgaggtctttgaaaacgaagatcaaaacaataatgaa

SEQ ID NO: 776 - DNA, 51 bp, Homo sapiens
  misc_feature (26)...(0): 2 of 2 allelic variants (775 is other entry)
  misc_feature (0)...(0): Accession number cg43929139
taatctgttcaacccgaggtctttggaaacgaagatcaaaacaataatgaa

SEQ ID NO: 777 - DNA, 51 bp, Homo sapiens
  misc_feature (26)...(0): 1 of 2 allelic variants (778 is other entry)
  misc_feature (0)...(0): Accession number cg43929139
aacaataatgaaccagagagcgaatcttgggatgatttctatcattgcaca

SEQ ID NO: 778 - DNA, 51 bp, Homo sapiens
  misc_feature (26)...(0): 2 of 2 allelic variants (777 is other entry)
  misc_feature (0)...(0): Accession number cg43929139
aacaataatgaaccagagagcgaattttgggatgatttctatcattgcaca

SEQ ID NO: 779 - DNA, 51 bp, Homo sapiens
  misc_feature (26)...(0): 1 of 2 allelic variants (780 is other entry)
  misc_feature (0)...(0): Accession number cg43929139
aatgaaccagagagcgaatcttgggatgatttctatcattgcacatacaaa

SEQ ID NO: 780 - DNA, 51 bp, Homo sapiens
  misc_feature (26)...(0): 2 of 2 allelic variants (779 is other entry)
  misc_feature (0)...(0): Accession number cg43929139
aatgaaccagagagcgaatcttggggtgatttctatcattgcacatacaaa

SEQ ID NO: 781 - DNA, 51 bp, Homo sapiens
  misc_feature (26)...(0): 1 of 2 allelic variants (782 is other entry)
  misc_feature (0)...(0): Accession number cg43929139
gatttctatcattgcacatacaaataatgggaattttagtatgttttatca

SEQ ID NO: 782 - DNA, 51 bp, Homo sapiens
  misc_feature (26)...(0): 2 of 2 allelic variants (781 is other entry)
  misc_feature (0)...(0): Accession number cg43929139
gatttctatcattgcacatacaaatgatgggaattttagtatgttttatca

SEQ ID NO: 783 - DNA, 51 bp, Homo sapiens
  misc_feature (26)...(0): 1 of 2 allelic variants (784 is other entry)
  misc_feature (0)...(0): Accession number cg43929652
cacttgttaggctcttgtcagcattgataactggcatgttttattgcagcc

SEQ ID NO: 784 - DNA, 51 bp, Homo sapiens
  misc_feature (26)...(0): 2 of 2 allelic variants (783 is other entry)
  misc_feature (0)...(0): Accession number cg43929652
cacttgttaggctcttgtcagcattaataactggcatgttttattgcagcc

SEQ ID NO: 785 - DNA, 51 bp, Homo sapiens
  misc_feature (26)...(0): 1 of 2 allelic variants (786 is other entry)
  misc_feature (0)...(0): Accession number cg43929990
gtgttaacttgaagagattcaacttcttctttgactggtacttccgcccta

SEQ ID NO: 786 - DNA, 51 bp, Homo sapiens
  misc_feature (26)...(0): 2 of 2 allelic variants (785 is other entry)
  misc_feature (0)...(0): Accession number cg43929990
gtgttaacttgaagagattcaactttttctttgactggtacttccgcccta

SEQ ID NO: 787 - DNA, 51 bp, Homo sapiens
  misc_feature (26)...(0): 1 of 2 allelic variants (788 is other entry)
  misc_feature (0)...(0): Accession number cg43931352
gcgtcgttcctccggtccatctcgctcatgctcagggcggtggcaaagggg

SEQ ID NO: 788 - DNA, 51 bp, Homo sapiens
  misc_feature (26)...(0): 2 of 2 allelic variants (787 is other entry)
  misc_feature (0)...(0): Accession number cg43931352
gcgtcgttcctccggtccatctcgcccatgctcagggcggtggcaaagggg

SEQ ID NO: 789 - DNA, 51 bp, Homo sapiens
  misc_feature (26)...(0): 1 of 2 allelic variants (790 is other entry)
  misc_feature (0)...(0): Accession number cg43931759
agctgggatgtacctggagagatagggggtagttctccctactgcccaggc

SEQ ID NO: 790 - DNA, 51 bp, Homo sapiens
  misc_feature (26)...(0): 2 of 2 allelic variants (789 is other entry)
  misc_feature (0)...(0): Accession number cg43931759
agctgggatgtacctggagagatagcgggtagttctccctactgcccaggc

SEQ ID NO: 791 - DNA, 51 bp, Homo sapiens
  misc_feature (26)...(0): 1 of 2 allelic variants (792 is other entry)
  misc_feature (0)...(0): Accession number cg43931795
agaatggcaggcggaccgtggcgaaggctctgccctggttgaacatttctg

SEQ ID NO: 792 - DNA, 50 bp, Homo sapiens
  misc_feature (26)...(0): 2 of 2 allelic variants (791 is other entry)
  misc_feature (25)...(26): nucleotide deleted between bases 25 and 26
  misc_feature (0)...(0): Accession number cg43931795
agaatggcaggcggaccgtggcgaagctctgccctggttgaacatttctg

SEQ ID NO: 793 - DNA, 51 bp, Homo sapiens
  misc_feature (26)...(0): 1 of 2 allelic variants (794 is other entry)
  misc_feature (0)...(0): Accession number cg43933469
tgtgccaggtgcccgtctgagctggctccatcatgacgcgtcactttgtcc

SEQ ID NO: 794 - DNA, 51 bp, Homo sapiens
  misc_feature (26)...(0): 2 of 2 allelic variants (793 is other entry)
  misc_feature (0)...(0): Accession number cg43933469
tgtgccaggtgcccgtctgagctggatccatcatgacgcgtcactttgtcc

SEQ ID NO: 795 - DNA, 51 bp, Homo sapiens
  misc_feature (26)...(0): 1 of 2 allelic variants (796 is other entry)
  misc_feature (0)...(0): Accession number cg43934707
cggtgggaccagcgccatcacctccgtacggatgttctccctccggaagcc

SEQ ID NO: 796 - DNA, 51 bp, Homo sapiens
  misc_feature (26)...(0): 2 of 2 allelic variants (795 is other entry)
  misc_feature (0)...(0): Accession number cg43934707
cggtgggaccagcgccatcacctccatacggatgttctccctccggaagcc

SEQ ID NO: 797 - DNA, 51 bp, Homo sapiens
  misc_feature (26)...(0): 1 of 2 allelic variants (798 is other entry)
  misc_feature (0)...(0): Accession number cg43934839
ccaaccatgcattaagtttaaccaaaagctgcaatattccagattcttaaa

SEQ ID NO: 798 - DNA, 51 bp, Homo sapiens
  misc_feature (26)...(0): 2 of 2 allelic variants (797 is other entry)
  misc_feature (0)...(0): Accession number cg43934839
ccaaccatgcattaagtttaaccaagagctgcaatattccagattcttaaa

SEQ ID NO: 799 - DNA, 51 bp, Homo sapiens
  misc_feature (26)...(0): 1 of 2 allelic variants (800 is other entry)
  misc_feature (0)...(0): Accession number cg43934839
ggtgcctgtttacttctggtctgcgcgggctcaggtttcaaagagcttgct

SEQ ID NO: 800 - DNA, 51 bp, Homo sapiens
  misc_feature (26)...(0): 2 of 2 allelic variants (799 is other entry)
  misc_feature (0)...(0): Accession number cg43934839
ggtgcctgtttacttctggtctgcgtgggctcaggtttcaaagagcttgct

SEQ ID NO: 801 - DNA, 51 bp, Homo sapiens
  misc_feature (26)...(0): 1 of 2 allelic variants (802 is other entry)
  misc_feature (0)...(0): Accession number cg43934938
tgaggaaacctaggaaatctcggtgcactaggaagtgaatcccgcaggaca

SEQ ID NO: 802 - DNA, 51 bp, Homo sapiens
  misc_feature (26)...(0): 2 of 2 allelic variants (801 is other entry)
  misc_feature (0)...(0): Accession number cg43934938
tgaggaaacctaggaaatctcggtgtactaggaagtgaatcccgcaggaca

SEQ ID NO: 803 - DNA, 51 bp, Homo sapiens
  misc_feature (26)...(0): 1 of 2 allelic variants (804 is other entry)
  misc_feature (0)...(0): Accession number cg43934938
tctcggtgcactaggaagtgaatcccgcaggacagctgcactcagggatac

SEQ ID NO: 804 - DNA, 51 bp, Homo sapiens
  misc_feature (26)...(0): 2 of 2 allelic variants (803 is other entry)
  misc_feature (0)...(0): Accession number cg43934938
tctcggtgcactaggaagtgaatcctgcaggacagctgcactcagggatac

SEQ ID NO: 805 - DNA, 51 bp, Homo sapiens
  misc_feature (26)...(0): 1 of 2 allelic variants (806 is other entry)
  misc_feature (0)...(0): Accession number cg43934938
gattgtctttctgccacagaacagcagcagacgtgtcgggaggttagctgc

SEQ ID NO: 806 - DNA, 51 bp, Homo sapiens
  misc_feature (26)...(0): 2 of 2 allelic variants (805 is other entry)
  misc_feature (0)...(0): Accession number cg43934938
gattgtctttctgccacagaacagctgcagacgtgtcgggaggttagctgc

SEQ ID NO: 807 - DNA, 51 bp, Homo sapiens
  misc_feature (26)...(0): 1 of 2 allelic variants (808 is other entry)
  misc_feature (0)...(0): Accession number cg43934938
aggttagctgcggaaagaaatcgggatgccgcggagcacagagtgatttgg

SEQ ID NO: 808 - DNA, 51 bp, Homo sapiens
  misc_feature (26)...(0): 2 of 2 allelic variants (807 is other entry)
  misc_feature (0)...(0): Accession number cg43934938
aggttagctgcggaaagaaatcgggctgccgcggagcacagagtgatttgg

SEQ ID NO: 809 - DNA, 51 bp, Homo sapiens
  misc_feature (26)...(0): 1 of 2 allelic variants (810 is other entry)
  misc_feature (0)...(0): Accession number cg43934938
tagctgcggaaagaaatcgggatgccgcggagcacagagtgatttggaact

SEQ ID NO: 810 - DNA, 51 bp, Homo sapiens
  misc_feature (26)...(0): 2 of 2 allelic variants (809 is other entry)
  misc_feature (0)...(0): Accession number cg43934938
tagctgcggaaagaaatcgggatgctgcggagcacagagtgatttggaact

SEQ ID NO: 811 - DNA, 51 bp, Homo sapiens
  misc_feature (26)...(0): 1 of 2 allelic variants (812 is other entry)
  misc_feature (0)...(0): Accession number cg43935748
atgctatgggtatctgtttcagaagctctgttggtatcttgtggtgtctgc

SEQ ID NO: 812 - DNA, 51 bp, Homo sapiens
  misc_feature (26)...(0): 2 of 2 allelic variants (811 is other entry)
  misc_feature (0)...(0): Accession number cg43935748
atgctatgggtatctgtttcagaagttctgttggtatcttgtggtgtctgc

SEQ ID NO: 813 - DNA, 51 bp, Homo sapiens
  misc_feature (26)...(0): 1 of 2 allelic variants (814 is other entry)
  misc_feature (0)...(0): Accession number cg43935826
tcattacggtcacaatgacgatgtcagaaaccatgcaatgaaaccaataaa

SEQ ID NO: 814 - DNA, 51 bp, Homo sapiens
  misc_feature (26)...(0): 2 of 2 allelic variants (813 is other entry)
  misc_feature (0)...(0): Accession number cg43935826
tcattacggtcacaatgacgatgtcggaaaccatgcaatgaaaccaataaa

SEQ ID NO: 815 - DNA, 51 bp, Homo sapiens
  misc_feature (26)...(0): 1 of 2 allelic variants (816 is other entry)
  misc_feature (0)...(0): Accession number cg43936051
tcagaaaaaaagctatccagcttttcgtggaatctggtgaagtttacactt

SEQ ID NO: 816 - DNA, 51 bp, Homo sapiens
  misc_feature (26)...(0): 2 of 2 allelic variants (815 is other entry)
  misc_feature (0)...(0): Accession number cg43936051
tcagaaaaaaagctatccagctttttgtggaatctggtgaagtttacactt

SEQ ID NO: 817 - DNA, 51 bp, Homo sapiens
  misc_feature (26)...(0): 1 of 2 allelic variants (818 is other entry)
  misc_feature (0)...(0): Accession number cg43939976
ccgtcggtcctggcgtagcgcctcccgtgtccggggtagatcttgtacccg

SEQ ID NO: 818 - DNA, 50 bp, Homo sapiens
  misc_feature (26)...(0): 2 of 2 allelic variants (817 is other entry)
  misc_feature (25)...(26): nucleotide deleted between bases 25 and 26
  misc_feature (0)...(0): Accession number cg43939976
ccgtcggtcctggcgtagcgcctccgtgtccggggtagatcttgtacccg

SEQ ID NO: 819 - DNA, 51 bp, Homo sapiens
  misc_feature (26)...(0): 1 of 2 allelic variants (820 is other entry)
  misc_feature (0)...(0): Accession number cg43941070
atgttccccggcctgcgaccaagacgctttttcctgactacttcttcaact

SEQ ID NO: 820 - DNA, 51 bp, Homo sapiens
  misc_feature (26)...(0): 2 of 2 allelic variants (819 is other entry)
  misc_feature (0)...(0): Accession number cg43941070
atgttccccggcctgcgaccaagacactttttcctgactacttcttcaact

SEQ ID NO: 821 - DNA, 51 bp, Homo sapiens
  misc_feature (26)...(0): 1 of 2 allelic variants (822 is other entry)
  misc_feature (0)...(0): Accession number cg43941070
cgctttttcctgactacttcttcaactctgacataggttttgctgatataa

SEQ ID NO: 822 - DNA, 51 bp, Homo sapiens
  misc_feature (26)...(0): 2 of 2 allelic variants (821 is other entry)
  misc_feature (0)...(0): Accession number cg43941070
cgctttttcctgactacttcttcaattctgacataggttttgctgatataa

SEQ ID NO: 823 - DNA, 51 bp, Homo sapiens
  misc_feature (26)...(0): 1 of 2 allelic variants (824 is other entry)
  misc_feature (0)...(0): Accession number cg43941070
ttcctgactacttcttcaactctgacataggttttgctgatataaacgcaa

SEQ ID NO: 824 - DNA, 51 bp, Homo sapiens
  misc_feature (26)...(0): 2 of 2 allelic variants (823 is other entry)
  misc_feature (0)...(0): Accession number cg43941070
ttcctgactacttcttcaactctgatataggttttgctgatataaacgcaa

SEQ ID NO: 825 - DNA, 51 bp, Homo sapiens
  misc_feature (26)...(0): 1 of 2 allelic variants (826 is other entry)
  misc_feature (0)...(0): Accession number cg43941070
ctgacataggttttgctgatataaacgcaaacccggctctatacctaccaa

SEQ ID NO: 826 - DNA, 51 bp, Homo sapiens
  misc_feature (26)...(0): 2 of 2 allelic variants (825 is other entry)
  misc_feature (0)...(0): Accession number cg43941070
ctgacataggttttgctgatataaatgcaaacccggctctatacctaccaa

SEQ ID NO: 827 - DNA, 51 bp, Homo sapiens
  misc_feature (26)...(0): 1 of 2 allelic variants (828 is other entry)
  misc_feature (0)...(0): Accession number cg43942215
agccaatatagggcctcgtctcactcaggtgtcagtgctgcagtatggaag

SEQ ID NO: 828 - DNA, 51 bp, Homo sapiens
  misc_feature (26)...(0): 2 of 2 allelic variants (827 is other entry)
  misc_feature (0)...(0): Accession number cg43942215
agccaatatagggcctcgtctcacttaggtgtcagtgctgcagtatggaag

SEQ ID NO: 829 - DNA, 51 bp, Homo sapiens
  misc_feature (26)...(0): 1 of 2 allelic variants (830 is other entry)
  misc_feature (0)...(0): Accession number cg43942920
tgcgtggtgacgggcagtgaggacatgtgcgtgcacttctttgatgtggag

SEQ ID NO: 830 - DNA, 51 bp, Homo sapiens
  misc_feature (26)...(0): 2 of 2 allelic variants (829 is other entry)
  misc_feature (0)...(0): Accession number cg43942920
tgcgtggtgacgggcagtgaggacaggtgcgtgcacttctttgatgtggag

SEQ ID NO: 831 - DNA, 51 bp, Homo sapiens
  misc_feature (26)...(0): 1 of 2 allelic variants (832 is other entry)
  misc_feature (0)...(0): Accession number cg43942990
ggctgtagaataccttctccttgacggggtacagcagctccacatccctct

SEQ ID NO: 832 - DNA, 51 bp, Homo sapiens
  misc_feature (26)...(0): 2 of 2 allelic variants (831 is other entry)
  misc_feature (0)...(0): Accession number cg43942990
ggctgtagaataccttctccttgacagggtacagcagctccacatccctct

SEQ ID NO: 833 - DNA, 51 bp, Homo sapiens
  misc_feature (26)...(0): 1 of 2 allelic variants (834 is other entry)
  misc_feature (0)...(0): Accession number cg43943163
ctgagctataaacttgtcatagatttgctgtgtcatcgcaggctgcaactg

SEQ ID NO: 834 - DNA, 51 bp, Homo sapiens
  misc_feature (26)...(0): 2 of 2 allelic variants (833 is other entry)
  misc_feature (0)...(0): Accession number cg43943163
ctgagctataaacttgtcatagattcgctgtgtcatcgcaggctgcaactg

SEQ ID NO: 835 - DNA, 50 bp, Homo sapiens
  misc_feature (26)...(0): 1 of 2 allelic variants (836 is other entry)
  misc_feature (25)...(26): nucleotide deleted between bases 25 and 26
  misc_feature (0)...(0): Accession number cg43944408
aggaggcaatgagatgatggggtgaggaaacatgaaagtaacacttgatt

SEQ ID NO: 836 - DNA, 51 bp, Homo sapiens
  misc_feature (26)...(0): 2 of 2 allelic variants (835 is other entry)
  misc_feature (0)...(0): Accession number cg43944408
aggaggcaatgagatgatggggtgagggaaacatgaaagtaacacttgatt

SEQ ID NO: 837 - DNA, 51 bp, Homo sapiens
  misc_feature (26)...(0): 1 of 2 allelic variants (838 is other entry)
  misc_feature (0)...(0): Accession number cg43944446
actctgatcggttattatcccctcattttttgtaggaaataagtttgcttg

SEQ ID NO: 838 - DNA, 50 bp, Homo sapiens
  misc_feature (26)...(0): 2 of 2 allelic variants (837 is other entry)
  misc_feature (25)...(26): nucleotide deleted between bases 25 and 26
  misc_feature (0)...(0): Accession number cg43944446
actctgatcggttattatcccctcatttttgtaggaaataagtttgcttg

SEQ ID NO: 839 - DNA, 51 bp, Homo sapiens
  misc_feature (26)...(0): 1 of 2 allelic variants (840 is other entry)
  misc_feature (0)...(0): Accession number cg43946473
cacagaaaagacaacagatgtgtttctaaggcacgatttacatactaaatt

SEQ ID NO: 840 - DNA, 51 bp, Homo sapiens
  misc_feature (26)...(0): 2 of 2 allelic variants (839 is other entry)
  misc_feature (0)...(0): Accession number cg43946473
cacagaaaagacaacagatgtgtttttaaggcacgatttacatactaaatt

SEQ ID NO: 841 - DNA, 51 bp, Homo sapiens
  misc_feature (26)...(0): 1 of 2 allelic variants (842 is other entry)
  misc_feature (0)...(0): Accession number cg43946992
acatctgggttgaccaggagccacaaaagttcccatcatgagaaagggggc

SEQ ID NO: 842 - DNA, 51 bp, Homo sapiens
  misc_feature (26)...(0): 2 of 2 allelic variants (841 is other entry)
  misc_feature (0)...(0): Accession number cg43946992
acatctgggttgaccaggagccacagaagttcccatcatgagaaagggggc

SEQ ID NO: 843 - DNA, 50 bp, Homo sapiens
  misc_feature (26)...(0): 1 of 2 allelic variants (844 is other entry)
  misc_feature (25)...(26): nucleotide deleted between bases 25 and 26
  misc_feature (0)...(0): Accession number cg43947759
tcaacttctgtaagatgggggggggacaaaaagagaagtaaagttaagaa

SEQ ID NO: 844 - DNA, 51 bp, Homo sapiens
  misc_feature (26)...(0): 2 of 2 allelic variants (843 is other entry)
  misc_feature (0)...(0): Accession number cg43947759
tcaacttctgtaagatggggggggggacaaaaagagaagtaaagttaagaa

SEQ ID NO: 845 - DNA, 51 bp, Homo sapiens
  misc_feature (26)...(0): 1 of 2 allelic variants (846 is other entry)
  misc_feature (0)...(0): Accession number cg43948617
agaggttatcaaggacatttaaggaatcctgatcctcagaacttctctggg

SEQ ID NO: 846 - DNA, 51 bp, Homo sapiens
  misc_feature (26)...(0): 2 of 2 allelic variants (845 is other entry)
  misc_feature (0)...(0): Accession number cg43948617
agaggttatcaaggacatttaaggagtcctgatcctcagaacttctctggg

SEQ ID NO: 847 - DNA, 51 bp, Homo sapiens
  misc_feature (26)...(0): 1 of 2 allelic variants (848 is other entry)
  misc_feature (0)...(0): Accession number cg43949585
gtaatgttaaaactaaatacagatgataataattgctatttcacagtgatg

SEQ ID NO: 848 - DNA, 51 bp, Homo sapiens
  misc_feature (26)...(0): 2 of 2 allelic variants (847 is other entry)
  misc_feature (0)...(0): Accession number cg43949585
gtaatgttaaaactaaatacagatggtaataattgctatttcacagtgatg

SEQ ID NO: 849 - DNA, 51 bp, Homo sapiens
  misc_feature (26)...(0): 1 of 2 allelic variants (850 is other entry)
  misc_feature (0)...(0): Accession number cg43949806
ttaccaaccctggggctttatactccctctccaccaatccctgatgacccc

SEQ ID NO: 850 - DNA, 51 bp, Homo sapiens
  misc_feature (26)...(0): 2 of 2 allelic variants (849 is other entry)
  misc_feature (0)...(0): Accession number cg43949806
ttaccaaccctggggctttatactctctctccaccaatccctgatgacccc

SEQ ID NO: 851 - DNA, 51 bp, Homo sapiens
  misc_feature (26)...(0): 1 of 2 allelic variants (852 is other entry)
  misc_feature (0)...(0): Accession number cg43950348
ggcattgcagcggctcggggtccaaagcctcactaccagtctgggtccggc

SEQ ID NO: 852 - DNA, 51 bp, Homo sapiens
  misc_feature (26)...(0): 2 of 2 allelic variants (851 is other entry)
  misc_feature (0)...(0): Accession number cg43950348
ggcattgcagcggctcggggtccaacgcctcactaccagtctgggtccggc

SEQ ID NO: 853 - DNA, 51 bp, Homo sapiens
  misc_feature (26)...(0): 1 of 2 allelic variants (854 is other entry)
  misc_feature (0)...(0): Accession number cg43950620
agcaaggaatgttcttattctttgtaggagctccttctttacactgtcagg

SEQ ID NO: 854 - DNA, 51 bp, Homo sapiens
  misc_feature (26)...(0): 2 of 2 allelic variants (853 is other entry)
  misc_feature (0)...(0): Accession number cg43950620
agcaaggaatgttcttattctttgtgggagctccttctttacactgtcagg

SEQ ID NO: 855 - DNA, 51 bp, Homo sapiens
  misc_feature (26)...(0): 1 of 2 allelic variants (856 is other entry)
  misc_feature (0)...(0): Accession number cg43951104
tagtgaaaaccaagtgacaaacacactcctcgaccccaagttcttccacat

SEQ ID NO: 856 - DNA, 51 bp, Homo sapiens
  misc_feature (26)...(0): 2 of 2 allelic variants (855 is other entry)
  misc_feature (0)...(0): Accession number cg43951104
tagtgaaaaccaagtgacaaacacattcctcgaccccaagttcttccacat

SEQ ID NO: 857 - DNA, 51 bp, Homo sapiens
  misc_feature (26)...(0): 1 of 2 allelic variants (858 is other entry)
  misc_feature (0)...(0): Accession number cg43951505
aaaggtggaaaatgaggttgatcgcagcattcagaaagtgtataagaccta

SEQ ID NO: 858 - DNA, 51 bp, Homo sapiens
  misc_feature (26)...(0): 2 of 2 allelic variants (857 is other entry)
  misc_feature (0)...(0): Accession number cg43951505
aaaggtggaaaatgaggttgatcgccgcattcagaaagtgtataagaccta

SEQ ID NO: 859 - DNA, 51 bp, Homo sapiens
  misc_feature (26)...(0): 1 of 2 allelic variants (860 is other entry)
  misc_feature (0)...(0): Accession number cg43952456
aatgctaaactgctttcatgctaattttctgactgtttacttaccgggtaa

SEQ ID NO: 860 - DNA, 51 bp, Homo sapiens
  misc_feature (26)...(0): 2 of 2 allelic variants (859 is other entry)
  misc_feature (0)...(0): Accession number cg43952456
aatgctaaactgctttcatgctaatcttctgactgtttacttaccgggtaa

SEQ ID NO: 861 - DNA, 51 bp, Homo sapiens
  misc_feature (26)...(0): 1 of 2 allelic variants (862 is other entry)
  misc_feature (0)...(0): Accession number cg43952456
aactgctttcatgctaattttctgactgtttacttaccgggtaagagcgat

SEQ ID NO: 862 - DNA, 51 bp, Homo sapiens
  misc_feature (26)...(0): 2 of 2 allelic variants (861 is other entry)
  misc_feature (0)...(0): Accession number cg43952456
aactgctttcatgctaattttctgaatgtttacttaccgggtaagagcgat

SEQ ID NO: 863 - DNA, 51 bp, Homo sapiens
  misc_feature (26)...(0): 1 of 2 allelic variants (864 is other entry)
  misc_feature (0)...(0): Accession number cg43952456
aattttctgactgtttacttaccgggtaagagcgatgggactgttttcatt

SEQ ID NO: 864 - DNA, 51 bp, Homo sapiens
  misc_feature (26)...(0): 2 of 2 allelic variants (863 is other entry)
  misc_feature (0)...(0): Accession number cg43952456
aattttctgactgtttacttaccggctaagagcgatgggactgttttcatt

SEQ ID NO: 865 - DNA, 51 bp, Homo sapiens
  misc_feature (26)...(0): 1 of 2 allelic variants (866 is other entry)
  misc_feature (0)...(0): Accession number cg43953844
ctcaacctgccttagctgcactctcttacctacagctggacagtacctgtc

SEQ ID NO: 866 - DNA, 51 bp, Homo sapiens
  misc_feature (26)...(0): 2 of 2 allelic variants (865 is other entry)
  misc_feature (0)...(0): Accession number cg43953844
ctcaacctgccttagctgcactctcctacctacagctggacagtacctgtc

SEQ ID NO: 867 - DNA, 51 bp, Homo sapiens
  misc_feature (26)...(0): 1 of 2 allelic variants (868 is other entry)
  misc_feature (0)...(0): Accession number cg43955665
ctgccagctgacaggatcttttgctgggcccccttctctgtgctgagtgga

SEQ ID NO: 868 - DNA, 51 bp, Homo sapiens
  misc_feature (26)...(0): 2 of 2 allelic variants (867 is other entry)
  misc_feature (0)...(0): Accession number cg43955665
ctgccagctgacaggatcttttgctaggcccccttctctgtgctgagtgga

SEQ ID NO: 869 - DNA, 51 bp, Homo sapiens
  misc_feature (26)...(0): 1 of 2 allelic variants (870 is other entry)
  misc_feature (0)...(0): Accession number cg43955829
ataaggccattcagcgagggaccatcaagtgcaactttgcgggggttgcct

SEQ ID NO: 870 - DNA, 51 bp, Homo sapiens
  misc_feature (26)...(0): 2 of 2 allelic variants (869 is other entry)
  misc_feature (0)...(0): Accession number cg43955829
ataaggccattcagcgagggaccattaagtgcaactttgcgggggttgcct

SEQ ID NO: 871 - DNA, 51 bp, Homo sapiens
  misc_feature (26)...(0): 1 of 2 allelic variants (872 is other entry)
  misc_feature (0)...(0): Accession number cg43955863
aggacaccaaggtacccaatgcctgtttattcaccatcaacaaagaagacc

SEQ ID NO: 872 - DNA, 51 bp, Homo sapiens
  misc_feature (26)...(0): 2 of 2 allelic variants (871 is other entry)
  misc_feature (0)...(0): Accession number cg43955863
aggacaccaaggtacccaatgcctgcttattcaccatcaacaaagaagacc

SEQ ID NO: 873 - DNA, 51 bp, Homo sapiens
  misc_feature (26)...(0): 1 of 2 allelic variants (874 is other entry)
  misc_feature (0)...(0): Accession number cg43955871
agcgctcctccagcagggacagctcactgatgaggtcggtgatggcgttgg

SEQ ID NO: 874 - DNA, 51 bp, Homo sapiens
  misc_feature (26)...(0): 2 of 2 allelic variants (873 is other entry)
  misc_feature (0)...(0): Accession number cg43955871
agcgctcctccagcagggacagctcgctgatgaggtcggtgatggcgttgg

SEQ ID NO: 875 - DNA, 51 bp, Homo sapiens
  misc_feature (26)...(0): 1 of 2 allelic variants (876 is other entry)
  misc_feature (0)...(0): Accession number cg43957194
ccatttttagcatcagaaacacaaggaaataaaattcgtggttagattgat

SEQ ID NO: 876 - DNA, 51 bp, Homo sapiens
  misc_feature (26)...(0): 2 of 2 allelic variants (875 is other entry)
  misc_feature (0)...(0): Accession number cg43957194
ccatttttagcatcagaaacacaagaaaataaaattcgtggttagattgat

SEQ ID NO: 877 - DNA, 51 bp, Homo sapiens
  misc_feature (26)...(0): 1 of 2 allelic variants (878 is other entry)
  misc_feature (0)...(0): Accession number cg43957205
atacctgaggtttcatgtctttagttgccttatcataatcccaaatataca

SEQ ID NO: 878 - DNA, 51 bp, Homo sapiens
  misc_feature (26)...(0): 2 of 2 allelic variants (877 is other entry)
  misc_feature (0)...(0): Accession number cg43957205
atacctgaggtttcatgtctttagtcgccttatcataatcccaaatataca

SEQ ID NO: 879 - DNA, 51 bp, Homo sapiens
  misc_feature (26)...(0): 1 of 2 allelic variants (880 is other entry)
  misc_feature (0)...(0): Accession number cg43958108
cagcaaacctgaatggcacaatggaacacagacttaaaagatgcttcagtg

SEQ ID NO: 880 - DNA, 51 bp, Homo sapiens
  misc_feature (26)...(0): 2 of 2 allelic variants (879 is other entry)
  misc_feature (0)...(0): Accession number cg43958108
cagcaaacctgaatggcacaatggagcacagacttaaaagatgcttcagtg

SEQ ID NO: 881 - DNA, 51 bp, Homo sapiens
  misc_feature (26)...(0): 1 of 2 allelic variants (882 is other entry)
  misc_feature (0)...(0): Accession number cg43959150
acttccacgcggtgaacgtggcgcacccgttcgcttcagcagtttcctagg

SEQ ID NO: 882 - DNA, 50 bp, Homo sapiens
  misc_feature (26)...(0): 2 of 2 allelic variants (881 is other entry)
  misc_feature (25)...(26): nucleotide deleted between bases 25 and 26
  misc_feature (0)...(0): Accession number cg43959150
acttccacgcggtgaacgtggcgcaccgttcgcttcagcagtttcctagg

SEQ ID NO: 883 - DNA, 51 bp, Homo sapiens
  misc_feature (26)...(0): 1 of 2 allelic variants (884 is other entry)
  misc_feature (0)...(0): Accession number cg43959363
cttcatttctttggtttcttgggtagtgggcgccggaacagcaagatgtga

SEQ ID NO: 884 - DNA, 51 bp, Homo sapiens
  misc_feature (26)...(0): 2 of 2 allelic variants (883 is other entry)
  misc_feature (0)...(0): Accession number cg43959363
cttcatttctttggtttcttgggtaatgggcgccggaacagcaagatgtga

SEQ ID NO: 885 - DNA, 41 bp, Homo sapiens
  misc_feature (16)...(0): 1 of 2 allelic variants (886 is other entry)
  misc_feature (0)...(0): Accession number cg43960242
actgcaacgcggaggagcaggatggagatccctgtgcctgt

SEQ ID NO: 886 - DNA, 41 bp, Homo sapiens
  misc_feature (16)...(0): 2 of 2 allelic variants (885 is other entry)
  misc_feature (0)...(0): Accession number cg43960242
actgcaacgcggaggggcaggatggagatccctgtgcctgt

SEQ ID NO: 887 - DNA, 51 bp, Homo sapiens
  misc_feature (26)...(0): 1 of 2 allelic variants (888 is other entry)
  misc_feature (0)...(0): Accession number cg43960953
aacagtgggcatgtcttctcgcggtcgatcggtttctctggctccttctta

SEQ ID NO: 888 - DNA, 51 bp, Homo sapiens
  misc_feature (26)...(0): 2 of 2 allelic variants (887 is other entry)
  misc_feature (0)...(0): Accession number cg43960953
aacagtgggcatgtcttctcgcggtagatcggtttctctggctccttctta

SEQ ID NO: 889 - DNA, 51 bp, Homo sapiens
  misc_feature (26)...(0): 1 of 2 allelic variants (890 is other entry)
  misc_feature (0)...(0): Accession number cg43962392
aaagaaggtagaggaacttgggagactgagggaaagataggagagaggaag

SEQ ID NO: 890 - DNA, 51 bp, Homo sapiens
  misc_feature (26)...(0): 2 of 2 allelic variants (889 is other entry)
  misc_feature (0)...(0): Accession number cg43962392
aaagaaggtagaggaacttgggagattgagggaaagataggagagaggaag

SEQ ID NO: 891 - DNA, 51 bp, Homo sapiens
  misc_feature (26)...(0): 1 of 2 allelic variants (892 is other entry)
  misc_feature (0)...(0): Accession number cg43964611
gctgggcttccccgagctggagagcggggaggaccagcccttctccaggct

SEQ ID NO: 892 - DNA, 51 bp, Homo sapiens
  misc_feature (26)...(0): 2 of 2 allelic variants (891 is other entry)
  misc_feature (0)...(0): Accession number cg43964611
gctgggcttccccgagctggagagcagggaggaccagcccttctccaggct

SEQ ID NO: 893 - DNA, 51 bp, Homo sapiens
  misc_feature (26)...(0): 1 of 2 allelic variants (894 is other entry)
  misc_feature (0)...(0): Accession number cg43965993
gtcgttttctcaaaaaaatatcgtataagtgactcatcctgtctgctaact

SEQ ID NO: 894 - DNA, 51 bp, Homo sapiens
  misc_feature (26)...(0): 2 of 2 allelic variants (893 is other entry)
  misc_feature (0)...(0): Accession number cg43965993
gtcgttttctcaaaaaaatatcgtacaagtgactcatcctgtctgctaact

SEQ ID NO: 895 - DNA, 51 bp, Homo sapiens
  misc_feature (26)...(0): 1 of 2 allelic variants (896 is other entry)
  misc_feature (0)...(0): Accession number cg43966536
cccagtatgtaccaccccgtttctcgtaaatgaaggcagcagctccagcca

SEQ ID NO: 896 - DNA, 51 bp, Homo sapiens
  misc_feature (26)...(0): 2 of 2 allelic variants (895 is other entry)
  misc_feature (0)...(0): Accession number cg43966536
cccagtatgtaccaccccgtttctcataaatgaaggcagcagctccagcca

SEQ ID NO: 897 - DNA, 51 bp, Homo sapiens
  misc_feature (26)...(0): 1 of 2 allelic variants (898 is other entry)
  misc_feature (0)...(0): Accession number cg43967276
cacgtgcgtggggtgttggcattcttgttatttaacacgggaaggaggtga

SEQ ID NO: 898 - DNA, 51 bp, Homo sapiens
  misc_feature (26)...(0): 2 of 2 allelic variants (897 is other entry)
  misc_feature (0)...(0): Accession number cg43967276
cacgtgcgtggggtgttggcattctcgttatttaacacgggaaggaggtga

SEQ ID NO: 899 - DNA, 51 bp, Homo sapiens
  misc_feature (26)...(0): 1 of 2 allelic variants (900 is other entry)
  misc_feature (0)...(0): Accession number cg43967511
tagtcctgttgacctggaaatggtggcaggtgaagtctctccacagcatgc

SEQ ID NO: 900 - DNA, 51 bp, Homo sapiens
  misc_feature (26)...(0): 2 of 2 allelic variants (899 is other entry)
  misc_feature (0)...(0): Accession number cg43967511
tagtcctgttgacctggaaatggtgccaggtgaagtctctccacagcatgc

SEQ ID NO: 901 - DNA, 51 bp, Homo sapiens
  misc_feature (26)...(0): 1 of 2 allelic variants (902 is other entry)
  misc_feature (0)...(0): Accession number cg43968814
gccagagcttccgcgccctcgcctgcccaggtgtcctgctcgcctccatct

SEQ ID NO: 902 - DNA, 51 bp, Homo sapiens
  misc_feature (26)...(0): 2 of 2 allelic variants (901 is other entry)
  misc_feature (0)...(0): Accession number cg43968814
gccagagcttccgcgccctcgcctgtccaggtgtcctgctcgcctccatct

SEQ ID NO: 903 - DNA, 51 bp, Homo sapiens
  misc_feature (26)...(0): 1 of 2 allelic variants (904 is other entry)
  misc_feature (0)...(0): Accession number cg43969044
cctctgatgttcagtgaagaggaccagaaaagtctgctagagcagtaccat

SEQ ID NO: 904 - DNA, 51 bp, Homo sapiens
  misc_feature (26)...(0): 2 of 2 allelic variants (903 is other entry)
  misc_feature (0)...(0): Accession number cg43969044
cctctgatgttcagtgaagaggaccggaaaagtctgctagagcagtaccat

SEQ ID NO: 905 - DNA, 51 bp, Homo sapiens
  misc_feature (26)...(0): 1 of 2 allelic variants (906 is other entry)
  misc_feature (0)...(0): Accession number cg43970408
ctctttggcttgttttggcgctggcgctggcagaggctgagacacggcgag

SEQ ID NO: 906 - DNA, 50 bp, Homo sapiens
  misc_feature (26)...(0): 2 of 2 allelic variants (905 is other entry)
  misc_feature (25)...(26): nucleotide deleted between bases 25 and 26
  misc_feature (0)...(0): Accession number cg43970408
ctctttggcttgttttggcgctggcctggcagaggctgagacacggcgag

SEQ ID NO: 907 - DNA, 51 bp, Homo sapiens
  misc_feature (26)...(0): 1 of 2 allelic variants (908 is other entry)
  misc_feature (0)...(0): Accession number cg43970722
ccaccatctccgttgtttctggaagcaccctccaggcaggccagccagcat

SEQ ID NO: 908 - DNA, 51 bp, Homo sapiens
  misc_feature (26)...(0): 2 of 2 allelic variants (907 is other entry)
  misc_feature (0)...(0): Accession number cg43970722
ccaccatctccgttgtttctggaagtaccctccaggcaggccagccagcat

SEQ ID NO: 909 - DNA, 51 bp, Homo sapiens
  misc_feature (26)...(0): 1 of 2 allelic variants (910 is other entry)
  misc_feature (0)...(0): Accession number cg43971702
ctcagctcctccaaatggttgtccaccccagacgactggggggttggtgga

SEQ ID NO: 910 - DNA, 51 bp, Homo sapiens
  misc_feature (26)...(0): 2 of 2 allelic variants (909 is other entry)
  misc_feature (0)...(0): Accession number cg43971702
ctcagctcctccaaatggttgtccatcccagacgactggggggttggtgga

SEQ ID NO: 911 - DNA, 51 bp, Homo sapiens
  misc_feature (26)...(0): 1 of 2 allelic variants (912 is other entry)
  misc_feature (0)...(0): Accession number cg43971764
cctcagcctcccaaagtgctgggattacaggcatgagccaccacgcccggc

SEQ ID NO: 912 - DNA, 51 bp, Homo sapiens
  misc_feature (26)...(0): 2 of 2 allelic variants (911 is other entry)
  misc_feature (0)...(0): Accession number cg43971764
cctcagcctcccaaagtgctgggatcacaggcatgagccaccacgcccggc

SEQ ID NO: 913 - DNA, 51 bp, Homo sapiens
  misc_feature (26)...(0): 1 of 2 allelic variants (914 is other entry)
  misc_feature (0)...(0): Accession number cg43972482
ttagtagagacggggtttcaccatgttggtcaggctggtctcgaactcctg

SEQ ID NO: 914 - DNA, 51 bp, Homo sapiens
  misc_feature (26)...(0): 2 of 2 allelic variants (913 is other entry)
  misc_feature (0)...(0): Accession number cg43972482
ttagtagagacggggtttcaccatgctggtcaggctggtctcgaactcctg

SEQ ID NO: 915 - DNA, 51 bp, Homo sapiens
  misc_feature (26)...(0): 1 of 2 allelic variants (916 is other entry)
  misc_feature (0)...(0): Accession number cg43973408
accgaggagcaggaatatgaggaggagcagccggaagaggaggctgcggag

SEQ ID NO: 916 - DNA, 51 bp, Homo sapiens
  misc_feature (26)...(0): 2 of 2 allelic variants (915 is other entry)
  misc_feature (0)...(0): Accession number cg43973408
accgaggagcaggaatatgaggaggggcagccggaagaggaggctgcggag

SEQ ID NO: 917 - DNA, 51 bp, Homo sapiens
  misc_feature (26)...(0): 1 of 2 allelic variants (918 is other entry)
  misc_feature (0)...(0): Accession number cg43974489
ggctagcccacctgccatggttgcctttctgcttggggatgccctgtctgg

SEQ ID NO: 918 - DNA, 51 bp, Homo sapiens
  misc_feature (26)...(0): 2 of 2 allelic variants (917 is other entry)
  misc_feature (0)...(0): Accession number cg43974489
ggctagcccacctgccatggttgcccttctgcttggggatgccctgtctgg

SEQ ID NO: 919 - DNA, 51 bp, Homo sapiens
  misc_feature (26)...(0): 1 of 2 allelic variants (920 is other entry)
  misc_feature (0)...(0): Accession number cg43974987
catcctcagagtctgagcggcaccgcagaccttctttttcaagttcactaa

SEQ ID NO: 920 - DNA, 50 bp, Homo sapiens
  misc_feature (26)...(0): 2 of 2 allelic variants (919 is other entry)
  misc_feature (25)...(26): nucleotide deleted between bases 25 and 26
  misc_feature (0)...(0): Accession number cg43974987
catcctcagagtctgagcggcaccgagaccttctttttcaagttcactaa

SEQ ID NO: 921 - DNA, 51 bp, Homo sapiens
  misc_feature (26)...(0): 1 of 2 allelic variants (922 is other entry)
  misc_feature (0)...(0): Accession number cg43977577
cgtagtgtaaagaacgtaaattgaaggccccgggccaattctgggaagagg

SEQ ID NO: 922 - DNA, 50 bp, Homo sapiens
  misc_feature (26)...(0): 2 of 2 allelic variants (921 is other entry)
  misc_feature (25)...(26): nucleotide deleted between bases 25 and 26
  misc_feature (0)...(0): Accession number cg43977577
cgtagtgtaaagaacgtaaattgaagccccgggccaattctgggaagagg

SEQ ID NO: 923 - DNA, 51 bp, Homo sapiens
  misc_feature (26)...(0): 1 of 2 allelic variants (924 is other entry)
  misc_feature (0)...(0): Accession number cg43977577
gtagtgtaaagaacgtaaattgaaggccccgggccaattctgggaagagga

SEQ ID NO: 924 - DNA, 50 bp, Homo sapiens
  misc_feature (26)...(0): 2 of 2 allelic variants (923 is other entry)
  misc_feature (25)...(26): nucleotide deleted between bases 25 and 26
  misc_feature (0)...(0): Accession number cg43977577
gtagtgtaaagaacgtaaattgaagccccgggccaattctgggaagagga

SEQ ID NO: 925 - DNA, 51 bp, Homo sapiens
  misc_feature (26)...(0): 1 of 2 allelic variants (926 is other entry)
  misc_feature (0)...(0): Accession number cg43977954
tgtgaacggcccggagagagctgggtggtgtatggggtgacctcctggggg

SEQ ID NO: 926 - DNA, 51 bp, Homo sapiens
  misc_feature (26)...(0): 2 of 2 allelic variants (925 is other entry)
  misc_feature (0)...(0): Accession number cg43977954
tgtgaacggcccggagagagctgggaggtgtatggggtgacctcctggggg

SEQ ID NO: 927 - DNA, 51 bp, Homo sapiens
  misc_feature (26)...(0): 1 of 2 allelic variants (928 is other entry)
  misc_feature (0)...(0): Accession number cg43979039
cgcccctcacagtgaagaatcaggacagccactctctggttttctcacaac

SEQ ID NO: 928 - DNA, 51 bp, Homo sapiens
  misc_feature (26)...(0): 2 of 2 allelic variants (927 is other entry)
  misc_feature (0)...(0): Accession number cg43979039
cgcccctcacagtgaagaatcaggagagccactctctggttttctcacaac

SEQ ID NO: 929 - DNA, 51 bp, Homo sapiens
  misc_feature (26)...(0): 1 of 2 allelic variants (930 is other entry)
  misc_feature (0)...(0): Accession number cg43979039
gtcctggtcccacacagagagaggaagcgccacaacccactctgccaacct

SEQ ID NO: 930 - DNA, 51 bp, Homo sapiens
  misc_feature (26)...(0): 2 of 2 allelic variants (929 is other entry)
  misc_feature (0)...(0): Accession number cg43979039
gtcctggtcccacacagagagaggaggcgccacaacccactctgccaacct

SEQ ID NO: 931 - DNA, 51 bp, Homo sapiens
  misc_feature (26)...(0): 1 of 2 allelic variants (932 is other entry)
  misc_feature (0)...(0): Accession number cg43980463
agaagctggctggtaggacccgcagggaccagctgaccaggcttgtgctca

SEQ ID NO: 932 - DNA, 50 bp, Homo sapiens
  misc_feature (26)...(0): 2 of 2 allelic variants (931 is other entry)
  misc_feature (25)...(26): nucleotide deleted between bases 25 and 26
  misc_feature (0)...(0): Accession number cg43980463
agaagctggctggtaggacccgcaggaccagctgaccaggcttgtgctca

SEQ ID NO: 933 - DNA, 51 bp, Homo sapiens
  misc_feature (26)...(0): 1 of 2 allelic variants (934 is other entry)
  misc_feature (0)...(0): Accession number cg43980508
ttcttgcaattatccaggcaggtgacgacaacttgatgcaggaaatcaacc

SEQ ID NO: 934 - DNA, 51 bp, Homo sapiens
  misc_feature (26)...(0): 2 of 2 allelic variants (933 is other entry)
  misc_feature (0)...(0): Accession number cg43980508
ttcttgcaattatccaggcaggtgatgacaacttgatgcaggaaatcaacc

SEQ ID NO: 935 - DNA, 51 bp, Homo sapiens
  misc_feature (26)...(0): 1 of 2 allelic variants (936 is other entry)
  misc_feature (0)...(0): Accession number cg43980653
ccccctcagccattgcccatgagggcctccacgttgtctgatggtcgctgg

SEQ ID NO: 936 - DNA, 50 bp, Homo sapiens
  misc_feature (26)...(0): 2 of 2 allelic variants (935 is other entry)
  misc_feature (25)...(26): nucleotide deleted between bases 25 and 26
  misc_feature (0)...(0): Accession number cg43980653
ccccctcagccattgcccatgagggctccacgttgtctgatggtcgctgg

SEQ ID NO: 937 - DNA, 51 bp, Homo sapiens
  misc_feature (26)...(0): 1 of 2 allelic variants (938 is other entry)
  misc_feature (0)...(0): Accession number cg43981661
tcatgagcccgctgacccggtgggccgagggcaggtagggagacttcctcg

SEQ ID NO: 938 - DNA, 51 bp, Homo sapiens
  misc_feature (26)...(0): 2 of 2 allelic variants (937 is other entry)
  misc_feature (0)...(0): Accession number cg43981661
tcatgagcccgctgacccggtgggctgagggcaggtagggagacttcctcg

SEQ ID NO: 939 - DNA, 51 bp, Homo sapiens
  misc_feature (26)...(0): 1 of 2 allelic variants (940 is other entry)
  misc_feature (0)...(0): Accession number cg43982025
tgggaaggcgcatatcctggcggcagcagcacgtggcaccaggtgccaggc

SEQ ID NO: 940 - DNA, 50 bp, Homo sapiens
  misc_feature (26)...(0): 2 of 2 allelic variants (939 is other entry)
  misc_feature (25)...(26): nucleotide deleted between bases 25 and 26
  misc_feature (0)...(0): Accession number cg43982025
tgggaaggcgcatatcctggcggcacagcacgtggcaccaggtgccaggc

SEQ ID NO: 941 - DNA, 51 bp, Homo sapiens
  misc_feature (26)...(0): 1 of 2 allelic variants (942 is other entry)
  misc_feature (0)...(0): Accession number cg43982782
ggtccctgccacagccgtggagggcggacgtgacctacgcggccatggtgg

SEQ ID NO: 942 - DNA, 51 bp, Homo sapiens
  misc_feature (26)...(0): 2 of 2 allelic variants (941 is other entry)
  misc_feature (0)...(0): Accession number cg43982782
ggtccctgccacagccgtggagggccgacgtgacctacgcggccatggtgg

SEQ ID NO: 943 - DNA, 51 bp, Homo sapiens
  misc_feature (26)...(0): 1 of 2 allelic variants (944 is other entry)
  misc_feature (0)...(0): Accession number cg43983035
caggcggacctggaggtgtcagccatggccctgaccacttcagaagccaac

SEQ ID NO: 944 - DNA, 51 bp, Homo sapiens
  misc_feature (26)...(0): 2 of 2 allelic variants (943 is other entry)
  misc_feature (0)...(0): Accession number cg43983035
caggcggacctggaggtgtcagccacggccctgaccacttcagaagccaac

SEQ ID NO: 945 - DNA, 51 bp, Homo sapiens
  misc_feature (26)...(0): 1 of 2 allelic variants (946 is other entry)
  misc_feature (0)...(0): Accession number cg43983194
ggccaaccatgaggagtgcaaagggtggcaccggccagtgcccctggacac

SEQ ID NO: 946 - DNA, 51 bp, Homo sapiens
  misc_feature (26)...(0): 2 of 2 allelic variants (945 is other entry)
  misc_feature (0)...(0): Accession number cg43983194
ggccaaccatgaggagtgcaaagggcggcaccggccagtgcccctggacac

SEQ ID NO: 947 - DNA, 51 bp, Homo sapiens
  misc_feature (26)...(0): 1 of 2 allelic variants (948 is other entry)
  misc_feature (0)...(0): Accession number cg43983194
gcagccatgcgcacctccacgcacggccgagctcaacccgaagaccacgcg

SEQ ID NO: 948 - DNA, 51 bp, Homo sapiens
  misc_feature (26)...(0): 2 of 2 allelic variants (947 is other entry)
  misc_feature (0)...(0): Accession number cg43983194
gcagccatgcgcacctccacgcacgaccgagctcaacccgaagaccacgcg

SEQ ID NO: 949 - DNA, 51 bp, Homo sapiens
  misc_feature (26)...(0): 1 of 2 allelic variants (950 is other entry)
  misc_feature (0)...(0): Accession number cg43983314
caaatggcaacataatgaaatcactttctgcatccagaattacacccccaa

SEQ ID NO: 950 - DNA, 51 bp, Homo sapiens
  misc_feature (26)...(0): 2 of 2 allelic variants (949 is other entry)
  misc_feature (0)...(0): Accession number cg43983314
caaatggcaacataatgaaatcactctctgcatccagaattacacccccaa

SEQ ID NO: 951 - DNA, 51 bp, Homo sapiens
  misc_feature (26)...(0): 1 of 2 allelic variants (952 is other entry)
  misc_feature (0)...(0): Accession number cg43983314
atggcaacataatgaaatcactttctgcatccagaattacacccccaaggt

SEQ ID NO: 952 - DNA, 51 bp, Homo sapiens
  misc_feature (26)...(0): 2 of 2 allelic variants (951 is other entry)
  misc_feature (0)...(0): Accession number cg43983314
atggcaacataatgaaatcactttcagcatccagaattacacccccaaggt

SEQ ID NO: 953 - DNA, 51 bp, Homo sapiens
  misc_feature (26)...(0): 1 of 2 allelic variants (954 is other entry)
  misc_feature (0)...(0): Accession number cg43983314
ccgcgaggtgccctatgcctacatccgtgagggccatgagaagcaggccga

SEQ ID NO: 954 - DNA, 51 bp, Homo sapiens
  misc_feature (26)...(0): 2 of 2 allelic variants (953 is other entry)
  misc_feature (0)...(0): Accession number cg43983314
ccgcgaggtgccctatgcctacatctgtgagggccatgagaagcaggccga

SEQ ID NO: 955 - DNA, 51 bp, Homo sapiens
  misc_feature (26)...(0): 1 of 2 allelic variants (956 is other entry)
  misc_feature (0)...(0): Accession number cg43984242
agctcatccagctggaccaggcgaacccctggccgctgtgctgaaggaggt

SEQ ID NO: 956 - DNA, 50 bp, Homo sapiens
  misc_feature (26)...(0): 2 of 2 allelic variants (955 is other entry)
  misc_feature (25)...(26): nucleotide deleted between bases 25 and 26
  misc_feature (0)...(0): Accession number cg43984242
agctcatccagctggaccaggcgaaccctggccgctgtgctgaaggaggt

SEQ ID NO: 957 - DNA, 51 bp, Homo sapiens
  misc_feature (26)...(0): 1 of 2 allelic variants (958 is other entry)
  misc_feature (0)...(0): Accession number cg43986540
gacaccgcctggcctggtgctccaggggtgaagcaggccagaatcctgggg

SEQ ID NO: 958 - DNA, 51 bp, Homo sapiens
  misc_feature (26)...(0): 2 of 2 allelic variants (957 is other entry)
  misc_feature (0)...(0): Accession number cg43986540
gacaccgcctggcctggtgctccagaggtgaagcaggccagaatcctgggg

SEQ ID NO: 959 - DNA, 51 bp, Homo sapiens
  misc_feature (26)...(0): 1 of 2 allelic variants (960 is other entry)
  misc_feature (0)...(0): Accession number cg43987682
agcccttctccagcaccttggcaaaaatgtccgtcagcacctctttgatgg

SEQ ID NO: 960 - DNA, 51 bp, Homo sapiens
  misc_feature (26)...(0): 2 of 2 allelic variants (959 is other entry)
  misc_feature (0)...(0): Accession number cg43987682
agcccttctccagcaccttggcaaagatgtccgtcagcacctctttgatgg

SEQ ID NO: 961 - DNA, 51 bp, Homo sapiens
  misc_feature (26)...(0): 1 of 2 allelic variants (962 is other entry)
  misc_feature (0)...(0): Accession number cg43991793
cccctgtgccatcatttgggccccccagacactggaggacagcgtgagata

SEQ ID NO: 962 - DNA, 51 bp, Homo sapiens
  misc_feature (26)...(0): 2 of 2 allelic variants (961 is other entry)
  misc_feature (0)...(0): Accession number cg43991793
cccctgtgccatcatttgggccccctagacactggaggacagcgtgagata

SEQ ID NO: 963 - DNA, 51 bp, Homo sapiens
  misc_feature (26)...(0): 1 of 2 allelic variants (964 is other entry)
  misc_feature (0)...(0): Accession number cg43991835
aaaagcggcgaggaacgcttgaaggaaatggaggcggagatggccctgttt

SEQ ID NO: 964 - DNA, 51 bp, Homo sapiens
  misc_feature (26)...(0): 2 of 2 allelic variants (963 is other entry)
  misc_feature (0)...(0): Accession number cg43991835
aaaagcggcgaggaacgcttgaagggaatggaggcggagatggccctgttt

SEQ ID NO: 965 - DNA, 51 bp, Homo sapiens
  misc_feature (26)...(0): 1 of 2 allelic variants (966 is other entry)
  misc_feature (0)...(0): Accession number cg43994222
cacagagattttacatcacctttcagaacgcaacagggtccgggacaggga

SEQ ID NO: 966 - DNA, 51 bp, Homo sapiens
  misc_feature (26)...(0): 2 of 2 allelic variants (965 is other entry)
  misc_feature (0)...(0): Accession number cg43994222
cacagagattttacatcacctttcaaaacgcaacagggtccgggacaggga

SEQ ID NO: 967 - DNA, 51 bp, Homo sapiens
  misc_feature (26)...(0): 1 of 2 allelic variants (968 is other entry)
  misc_feature (0)...(0): Accession number cg43995297
aggatccctggctcgcgtccccaaccggttccgtgtctcacctgggtcctg

SEQ ID NO: 968 - DNA, 51 bp, Homo sapiens
  misc_feature (26)...(0): 2 of 2 allelic variants (967 is other entry)
  misc_feature (0)...(0): Accession number cg43995297
aggatccctggctcgcgtccccaactggttccgtgtctcacctgggtcctg

SEQ ID NO: 969 - DNA, 51 bp, Homo sapiens
  misc_feature (26)...(0): 1 of 2 allelic variants (970 is other entry)
  misc_feature (0)...(0): Accession number cg43995517
tggccgtaggagaaaatacaaccctacccggaacagcaatagctcccgcca

SEQ ID NO: 970 - DNA, 51 bp, Homo sapiens
  misc_feature (26)...(0): 2 of 2 allelic variants (969 is other entry)
  misc_feature (0)...(0): Accession number cg43995517
tggccgtaggagaaaatacaaccctgcccggaacagcaatagctcccgcca

SEQ ID NO: 971 - DNA, 51 bp, Homo sapiens
  misc_feature (26)...(0): 1 of 2 allelic variants (972 is other entry)
  misc_feature (0)...(0): Accession number cg43995517
ttaccttggaacccagccctacagcccgagcagctgtccctctgcctcccc

SEQ ID NO: 972 - DNA, 51 bp, Homo sapiens
  misc_feature (26)...(0): 2 of 2 allelic variants (971 is other entry)
  misc_feature (0)...(0): Accession number cg43995517
ttaccttggaacccagccctacagcgcgagcagctgtccctctgcctcccc

SEQ ID NO: 973 - DNA, 51 bp, Homo sapiens
  misc_feature (26)...(0): 1 of 2 allelic variants (974 is other entry)
  misc_feature (0)...(0): Accession number cg43995517
ccctacagcccgagcagctgtccctctgcctccccgggcccgccctggccg

SEQ ID NO: 974 - DNA, 51 bp, Homo sapiens
  misc_feature (26)...(0): 2 of 2 allelic variants (973 is other entry)
  misc_feature (0)...(0): Accession number cg43995517
ccctacagcccgagcagctgtccctttgcctccccgggcccgccctggccg

SEQ ID NO: 975 - DNA, 51 bp, Homo sapiens
  misc_feature (26)...(0): 1 of 2 allelic variants (976 is other entry)
  misc_feature (0)...(0): Accession number cg43997174
ggtcatcacacacaagtggaccaccagcctgagtgcaaaattcaagtgcac

SEQ ID NO: 976 - DNA, 51 bp, Homo sapiens
  misc_feature (26)...(0): 2 of 2 allelic variants (975 is other entry)
  misc_feature (0)...(0): Accession number cg43997174
ggtcatcacacacaagtggaccaccggcctgagtgcaaaattcaagtgcac

SEQ ID NO: 977 - DNA, 51 bp, Homo sapiens
  misc_feature (26)...(0): 1 of 2 allelic variants (978 is other entry)
  misc_feature (0)...(0): Accession number cg43997490
aacatgaggaccctctggattaatcgaattacagctgctagccaggaacat

SEQ ID NO: 978 - DNA, 51 bp, Homo sapiens
  misc_feature (26)...(0): 2 of 2 allelic variants (977 is other entry)
  misc_feature (0)...(0): Accession number cg43997490
aacatgaggaccctctggattaatcaaattacagctgctagccaggaacat

SEQ ID NO: 979 - DNA, 51 bp, Homo sapiens
  misc_feature (26)...(0): 1 of 2 allelic variants (980 is other entry)
  misc_feature (0)...(0): Accession number cg43997710
atgtgaggtgtgacctcacgaagaagcaaatttaatattataatgggaagc

SEQ ID NO: 980 - DNA, 51 bp, Homo sapiens
  misc_feature (26)...(0): 2 of 2 allelic variants (979 is other entry)
  misc_feature (0)...(0): Accession number cg43997710
atgtgaggtgtgacctcacgaagaaacaaatttaatattataatgggaagc

SEQ ID NO: 981 - DNA, 51 bp, Homo sapiens
  misc_feature (26)...(0): 1 of 2 allelic variants (982 is other entry)
  misc_feature (0)...(0): Accession number cg43997768
agatcccaaagcccagtacacaagtatctacggagccctcaagaaaatcat

SEQ ID NO: 982 - DNA, 51 bp, Homo sapiens
  misc_feature (26)...(0): 2 of 2 allelic variants (981 is other entry)
  misc_feature (0)...(0): Accession number cg43997768
agatcccaaagcccagtacacaagtgtctacggagccctcaagaaaatcat

SEQ ID NO: 983 - DNA, 50 bp, Homo sapiens
  misc_feature (26)...(0): 1 of 2 allelic variants (984 is other entry)
  misc_feature (25)...(26): nucleotide deleted between bases 25 and 26
  misc_feature (0)...(0): Accession number cg43999766
catgtgaagagacccagcctcttcaagggtatccaagataaacttccgtt

SEQ ID NO: 984 - DNA, 51 bp, Homo sapiens
  misc_feature (26)...(0): 2 of 2 allelic variants (983 is other entry)
  misc_feature (0)...(0): Accession number cg43999766
catgtgaagagacccagcctcttcatagggtatccaagataaacttccgtt

SEQ ID NO: 985 - DNA, 51 bp, Homo sapiens
  misc_feature (26)...(0): 1 of 2 allelic variants (986 is other entry)
  misc_feature (0)...(0): Accession number cg44000102
cttattcttctttgaatacaatgacttctggcactgatcgggtcagtttct

SEQ ID NO: 986 - DNA, 50 bp, Homo sapiens
  misc_feature (26)...(0): 2 of 2 allelic variants (985 is other entry)
  misc_feature (25)...(26): nucleotide deleted between bases 25 and 26
  misc_feature (0)...(0): Accession number cg44000102
cttattcttctttgaatacaatgactctggcactgatcgggtcagtttct

SEQ ID NO: 987 - DNA, 51 bp, Homo sapiens
  misc_feature (26)...(0): 1 of 2 allelic variants (988 is other entry)
  misc_feature (0)...(0): Accession number cg44000102
ttattcttctttgaatacaatgacttctggcactgatcgggtcagtttctt

SEQ ID NO: 988 - DNA, 50 bp, Homo sapiens
  misc_feature (26)...(0): 2 of 2 allelic variants (987 is other entry)
  misc_feature (25)...(26): nucleotide deleted between bases 25 and 26
  misc_feature (0)...(0): Accession number cg44000102
ttattcttctttgaatacaatgactctggcactgatcgggtcagtttctt

SEQ ID NO: 989 - DNA, 51 bp, Homo sapiens
  misc_feature (26)...(0): 1 of 2 allelic variants (990 is other entry)
  misc_feature (0)...(0): Accession number cg44000102
attcttctttgaatacaatgacttctggcactgatcgggtcagtttcttcc

SEQ ID NO: 990 - DNA, 50 bp, Homo sapiens
  misc_feature (26)...(0): 2 of 2 allelic variants (989 is other entry)
  misc_feature (25)...(26): nucleotide deleted between bases 25 and 26
  misc_feature (0)...(0): Accession number cg44000102
attcttctttgaatacaatgacttcggcactgatcgggtcagtttcttcc

SEQ ID NO: 991 - DNA, 50 bp, Homo sapiens
  misc_feature (26)...(0): 1 of 2 allelic variants (992 is other entry)
  misc_feature (25)...(26): nucleotide deleted between bases 25 and 26
  misc_feature (0)...(0): Accession number cg44000241
ctccctcacggagccagcggccgggaatgcagacatcagaacgtgagggg

SEQ ID NO: 992 - DNA, 51 bp, Homo sapiens
  misc_feature (26)...(0): 2 of 2 allelic variants (991 is other entry)
  misc_feature (0)...(0): Accession number cg44000241
ctccctcacggagccagcggccgggtaatgcagacatcagaacgtgagggg

SEQ ID NO: 993 - DNA, 51 bp, Homo sapiens
  misc_feature (26)...(0): 1 of 2 allelic variants (994 is other entry)
  misc_feature (0)...(0): Accession number cg44001933
ctccgcgcacagtggtggccaccgccactggtgctgaagtgtcggcgtgtg

SEQ ID NO: 994 - DNA, 51 bp, Homo sapiens
  misc_feature (26)...(0): 2 of 2 allelic variants (993 is other entry)
  misc_feature (0)...(0): Accession number cg44001933
ctccgcgcacagtggtggccaccgcgactggtgctgaagtgtcggcgtgtg

SEQ ID NO: 995 - DNA, 42 bp, Homo sapiens
  misc_feature (17)...(0): 1 of 2 allelic variants (996 is other entry)
  misc_feature (0)...(0): Accession number cg44002491
gcgcgcccttcttcccttactgcgaggagccaccgcctcttt

SEQ ID NO: 996 - DNA, 42 bp, Homo sapiens
  misc_feature (17)...(0): 2 of 2 allelic variants (995 is other entry)
  misc_feature (0)...(0): Accession number cg44002491
gcgcgcccttcttcccctactgcgaggagccaccgcctcttt

SEQ ID NO: 997 - DNA, 51 bp, Homo sapiens
  misc_feature (26)...(0): 1 of 2 allelic variants (998 is other entry)
  misc_feature (0)...(0): Accession number cg44003839
ccccatcaccaggcggttctccccgatctccagcgacagccccagggctcc

SEQ ID NO: 998 - DNA, 51 bp, Homo sapiens
  misc_feature (26)...(0): 2 of 2 allelic variants (997 is other entry)
  misc_feature (0)...(0): Accession number cg44003839
ccccatcaccaggcggttctccccggtctccagcgacagccccagggctcc

SEQ ID NO: 999 - DNA, 51 bp, Homo sapiens
  misc_feature (26)...(0): 1 of 2 allelic variants (1000 is other entry)
  misc_feature (0)...(0): Accession number cg44003987
cacacgcacacgtacattcactacaaacgtgcagcctcctgcacacgtgca

SEQ ID NO: 1000 - DNA, 51 bp, Homo sapiens
  misc_feature (26)...(0): 2 of 2 allelic variants (999 is other entry)
  misc_feature (0)...(0): Accession number cg44003987
cacacgcacacgtacattcactacacacgtgcagcctcctgcacacgtgca

SEQ ID NO: 1001 - DNA, 51 bp, Homo sapiens
  misc_feature (26)...(0): 1 of 2 allelic variants (1002 is other entry)
  misc_feature (0)...(0): Accession number cg44005542
tcctaatcccatgccagaaccgaaggctaatggccacattcttcttttaaa

SEQ ID NO: 1002 - DNA, 50 bp, Homo sapiens
  misc_feature (26)...(0): 2 of 2 allelic variants (1001 is other entry)
  misc_feature (25)...(26): nucleotide deleted between bases 25 and 26
  misc_feature (0)...(0): Accession number cg44005542
tcctaatcccatgccagaaccgaagctaatggccacattcttcttttaaa

SEQ ID NO: 1003 - DNA, 51 bp, Homo sapiens
  misc_feature (26)...(0): 1 of 2 allelic variants (1004 is other entry)
  misc_feature (0)...(0): Accession number cg44007769
gggtctgctgagttggaggagtgcaatgtcgccctgggagccctcctggag

SEQ ID NO: 1004 - DNA, 51 bp, Homo sapiens
  misc_feature (26)...(0): 2 of 2 allelic variants (1003 is other entry)
  misc_feature (0)...(0): Accession number cg44007769
gggtctgctgagttggaggagtgcattgtcgccctgggagccctcctggag

SEQ ID NO: 1005 - DNA, 51 bp, Homo sapiens
  misc_feature (26)...(0): 1 of 2 allelic variants (1006 is other entry)
  misc_feature (0)...(0): Accession number cg44009153
agccatgggtttgggtaataagaagagagagcatttggggttcaagagagg

SEQ ID NO: 1006 - DNA, 51 bp, Homo sapiens
  misc_feature (26)...(0): 2 of 2 allelic variants (1005 is other entry)
  misc_feature (0)...(0): Accession number cg44009153
agccatgggtttgggtaataagaagggagagcatttggggttcaagagagg

SEQ ID NO: 1007 - DNA, 51 bp, Homo sapiens
  misc_feature (26)...(0): 1 of 2 allelic variants (1008 is other entry)
  misc_feature (0)...(0): Accession number cg44009645
cttttccatgtggctcaatatcaacttttcccgtctaatgatgacaaatct

SEQ ID NO: 1008 - DNA, 51 bp, Homo sapiens
  misc_feature (26)...(0): 2 of 2 allelic variants (1007 is other entry)
  misc_feature (0)...(0): Accession number cg44009645
cttttccatgtggctcaatatcaacctttcccgtctaatgatgacaaatct

SEQ ID NO: 1009 - DNA, 51 bp, Homo sapiens
  misc_feature (26)...(0): 1 of 2 allelic variants (1010 is other entry)
  misc_feature (0)...(0): Accession number cg44012500
ggcatctcatcttgctggggctgttgggtcccctggacctcaaatcccaat

SEQ ID NO: 1010 - DNA, 50 bp, Homo sapiens
  misc_feature (26)...(0): 2 of 2 allelic variants (1009 is other entry)
  misc_feature (25)...(26): nucleotide deleted between bases 25 and 26
  misc_feature (0)...(0): Accession number cg44012500
ggcatctcatcttgctggggctgttggtcccctggacctcaaatcccaat

SEQ ID NO: 1011 - DNA, 51 bp, Homo sapiens
  misc_feature (26)...(0): 1 of 2 allelic variants (1012 is other entry)
  misc_feature (0)...(0): Accession number cg44014720
cagagccctgtcgtggccctgtccatctcctgcgccaggaaacacaggttc

SEQ ID NO: 1012 - DNA, 51 bp, Homo sapiens
  misc_feature (26)...(0): 2 of 2 allelic variants (1011 is other entry)
  misc_feature (0)...(0): Accession number cg44014720
cagagccctgtcgtggccctgtccacctcctgcgccaggaaacacaggttc

SEQ ID NO: 1013 - DNA, 51 bp, Homo sapiens
  misc_feature (26)...(0): 1 of 2 allelic variants (1014 is other entry)
  misc_feature (0)...(0): Accession number cg44020161
ctccaagagttctggtctcccgcgaggggcggagttccctccccagtcccg

SEQ ID NO: 1014 - DNA, 50 bp, Homo sapiens
  misc_feature (26)...(0): 2 of 2 allelic variants (1013 is other entry)
  misc_feature (25)...(26): nucleotide deleted between bases 25 and 26
  misc_feature (0)...(0): Accession number cg44020161
ctccaagagttctggtctcccgcgagggcggagttccctccccagtcccg

SEQ ID NO: 1015 - DNA, 51 bp, Homo sapiens
  misc_feature (26)...(0): 1 of 2 allelic variants (1016 is other entry)
  misc_feature (0)...(0): Accession number cg44021014
gaggcacacagacagatgatgagcagctcttctccttaaagaagtctgtgt

SEQ ID NO: 1016 - DNA, 51 bp, Homo sapiens
  misc_feature (26)...(0): 2 of 2 allelic variants (1015 is other entry)
  misc_feature (0)...(0): Accession number cg44021014
gaggcacacagacagatgatgagcaactcttctccttaaagaagtctgtgt

SEQ ID NO: 1017 - DNA, 48 bp, Homo sapiens
  misc_feature (26)...(0): 1 of 2 allelic variants (1018 is other entry)
  misc_feature (0)...(0): Accession number cg44024536
agggtgtgtgtgtgtgtgtgtgtgtgtgtgtgtgtgtgtgcgtgtgcg

SEQ ID NO: 1018 - DNA, 48 bp, Homo sapiens
  misc_feature (26)...(0): 2 of 2 allelic variants (1017 is other entry)
  misc_feature (0)...(0): Accession number cg44024536
agggtgtgtgtgtgtgtgtgtgtgtatgtgtgtgtgtgtgcgtgtgcg

SEQ ID NO: 1019 - DNA, 44 bp, Homo sapiens
  misc_feature (26)...(0): 1 of 2 allelic variants (1020 is other entry)
  misc_feature (0)...(0): Accession number cg44024536
tgtgtgtgtgtgtgtgtgtgtgtgtgtgtgtgtgtgcgtgtgcg

SEQ ID NO: 1020 - DNA, 44 bp, Homo sapiens
  misc_feature (26)...(0): 2 of 2 allelic variants (1019 is other entry)
  misc_feature (0)...(0): Accession number cg44024536
tgtgtgtgtgtgtgtgtgtgtgtgtatgtgtgtgtgcgtgtgcg

SEQ ID NO: 1021 - DNA, 51 bp, Homo sapiens
  misc_feature (26)...(0): 1 of 2 allelic variants (1022 is other entry)
  misc_feature (0)...(0): Accession number cg44026832
tggctgcagaggttgagcctcctgagcccctgcttggtgacaagggacctg

SEQ ID NO: 1022 - DNA, 51 bp, Homo sapiens
  misc_feature (26)...(0): 2 of 2 allelic variants (1021 is other entry)
  misc_feature (0)...(0): Accession number cg44026832
tggctgcagaggttgagcctcctgaacccctgcttggtgacaagggacctg

SEQ ID NO: 1023 - DNA, 51 bp, Homo sapiens
  misc_feature (26)...(0): 1 of 2 allelic variants (1024 is other entry)
  misc_feature (0)...(0): Accession number cg44026832
cttctgggctgtggccctgctcttgctggctactctcatggagcagggctt

SEQ ID NO: 1024 - DNA, 51 bp, Homo sapiens
  misc_feature (26)...(0): 2 of 2 allelic variants (1023 is other entry)
  misc_feature (0)...(0): Accession number cg44026832
cttctgggctgtggccctgctcttgttggctactctcatggagcagggctt

SEQ ID NO: 1025 - DNA, 51 bp, Homo sapiens
  misc_feature (26)...(0): 1 of 2 allelic variants (1026 is other entry)
  misc_feature (0)...(0): Accession number cg44029982
ggctgtaggggatgttggtctcctggaaaaaggcgctgagggctgtctcga

SEQ ID NO: 1026 - DNA, 51 bp, Homo sapiens
  misc_feature (26)...(0): 2 of 2 allelic variants (1025 is other entry)
  misc_feature (0)...(0): Accession number cg44029982
ggctgtaggggatgttggtctcctgaaaaaaggcgctgagggctgtctcga

SEQ ID NO: 1027 - DNA, 51 bp, Homo sapiens
  misc_feature (26)...(0): 1 of 2 allelic variants (1028 is other entry)
  misc_feature (0)...(0): Accession number cg44030164
gggtgtagacgctgctggccagcccgccgcagccgaggttctcggcaccgc

SEQ ID NO: 1028 - DNA, 51 bp, Homo sapiens
  misc_feature (26)...(0): 2 of 2 allelic variants (1027 is other entry)
  misc_feature (0)...(0): Accession number cg44030164
gggtgtagacgctgctggccagccctccgcagccgaggttctcggcaccgc

SEQ ID NO: 1029 - DNA, 51 bp, Homo sapiens
  misc_feature (26)...(0): 1 of 2 allelic variants (1030 is other entry)
  misc_feature (0)...(0): Accession number cg44031677
cagacccgaggtgcccagggcattccggaggcagccgagggcagcagctcc

SEQ ID NO: 1030 - DNA, 51 bp, Homo sapiens
  misc_feature (26)...(0): 2 of 2 allelic variants (1029 is other entry)
  misc_feature (0)...(0): Accession number cg44031677
cagacccgaggtgcccagggcattctggaggcagccgagggcagcagctcc

SEQ ID NO: 1031 - DNA, 51 bp, Homo sapiens
  misc_feature (26)...(0): 1 of 2 allelic variants (1032 is other entry)
  misc_feature (0)...(0): Accession number cg44031863
ggacttctgctgcgtcttcggccacctctcctcttgccttttggtggaccc

SEQ ID NO: 1032 - DNA, 51 bp, Homo sapiens
  misc_feature (26)...(0): 2 of 2 allelic variants (1031 is other entry)
  misc_feature (0)...(0): Accession number cg44031863
ggacttctgctgcgtcttcggccacttctcctcttgccttttggtggaccc

SEQ ID NO: 1033 - DNA, 51 bp, Homo sapiens
  misc_feature (26)...(0): 1 of 2 allelic variants (1034 is other entry)
  misc_feature (0)...(0): Accession number cg44033624
gaaaagggatactttgataattaaggccagaggcccattagttgagaaagt

SEQ ID NO: 1034 - DNA, 50 bp, Homo sapiens
  misc_feature (26)...(0): 2 of 2 allelic variants (1033 is other entry)
  misc_feature (25)...(26): nucleotide deleted between bases 25 and 26
  misc_feature (0)...(0): Accession number cg44033624
gaaaagggatactttgataattaagccagaggcccattagttgagaaagt

SEQ ID NO: 1035 - DNA, 51 bp, Homo sapiens
  misc_feature (26)...(0): 1 of 2 allelic variants (1036 is other entry)
  misc_feature (0)...(0): Accession number cg44033878
aaggagggatatgttccacgtaacttgctgggactgtacccaagaattaaa

SEQ ID NO: 1036 - DNA, 51 bp, Homo sapiens
  misc_feature (26)...(0): 2 of 2 allelic variants (1035 is other entry)
  misc_feature (0)...(0): Accession number cg44033878
aaggagggatatgttccacgtaactggctgggactgtacccaagaattaaa

SEQ ID NO: 1037 - DNA, 51 bp, Homo sapiens
  misc_feature (26)...(0): 1 of 2 allelic variants (1038 is other entry)
  misc_feature (0)...(0): Accession number cg44034830
gcaggagcctgcaggaggctggaaagtcaggctagggatatagcagggatg

SEQ ID NO: 1038 - DNA, 51 bp, Homo sapiens
  misc_feature (26)...(0): 2 of 2 allelic variants (1037 is other entry)
  misc_feature (0)...(0): Accession number cg44034830
gcaggagcctgcaggaggctggaaaatcaggctagggatatagcagggatg

SEQ ID NO: 1039 - DNA, 51 bp, Homo sapiens
  misc_feature (26)...(0): 1 of 2 allelic variants (1040 is other entry)
  misc_feature (0)...(0): Accession number cg44127556
tggcgacgactctggagtggcggatacgggggaggcggatgtccctgggtc

SEQ ID NO: 1040 - DNA, 51 bp, Homo sapiens
  misc_feature (26)...(0): 2 of 2 allelic variants (1039 is other entry)
  misc_feature (0)...(0): Accession number cg44127556
tggcgacgactctggagtggcggatgcgggggaggcggatgtccctgggtc

SEQ ID NO: 1041 - DNA, 51 bp, Homo sapiens
  misc_feature (26)...(0): 1 of 2 allelic variants (1042 is other entry)
  misc_feature (0)...(0): Accession number cg44128344
ccccaggattctggcctgcttcacctctggagcaccaggccaggcggtgtc

SEQ ID NO: 1042 - DNA, 51 bp, Homo sapiens
  misc_feature (26)...(0): 2 of 2 allelic variants (1041 is other entry)
  misc_feature (0)...(0): Accession number cg44128344
ccccaggattctggcctgcttcacccctggagcaccaggccaggcggtgtc

SEQ ID NO: 1043 - DNA, 51 bp, Homo sapiens
  misc_feature (26)...(0): 1 of 2 allelic variants (1044 is other entry)
  misc_feature (0)...(0): Accession number cg44131644
tggcccccgacgagctgtacacgccgcacagctggctgctccgcgtggtat

SEQ ID NO: 1044 - DNA, 51 bp, Homo sapiens
  misc_feature (26)...(0): 2 of 2 allelic variants (1043 is other entry)
  misc_feature (0)...(0): Accession number cg44131644
tggcccccgacgagctgtacacgccccacagctggctgctccgcgtggtat

SEQ ID NO: 1045 - DNA, 51 bp, Homo sapiens
  misc_feature (26)...(0): 1 of 2 allelic variants (1046 is other entry)
  misc_feature (0)...(0): Accession number cg44911913
agggcggctgcggggctgcccctggccccccggcccctcctgggcgccctc

SEQ ID NO: 1046 - DNA, 51 bp, Homo sapiens
  misc_feature (26)...(0): 2 of 2 allelic variants (1045 is other entry)
  misc_feature (0)...(0): Accession number cg44911913
agggcggctgcggggctgcccctggtcccccggcccctcctgggcgccctc

SEQ ID NO: 1047 - DNA, 51 bp, Homo sapiens
  misc_feature (26)...(0): 1 of 2 allelic variants (1048 is other entry)
  misc_feature (0)...(0): Accession number cg44911913
ccccccggcccctcctgggcgccctcgtcccgctcctggccctgctccctg

SEQ ID NO: 1048 - DNA, 51 bp, Homo sapiens
  misc_feature (26)...(0): 2 of 2 allelic variants (1047 is other entry)
  misc_feature (0)...(0): Accession number cg44911913
ccccccggcccctcctgggcgccctggtcccgctcctggccctgctccctg

SEQ ID NO: 1049 - DNA, 51 bp, Homo sapiens
  misc_feature (26)...(0): 1 of 2 allelic variants (1050 is other entry)
  misc_feature (0)...(0): Accession number cg44912347
tctttacattagagccaatttaagaaggcgctggtatgtatgagctttttg

SEQ ID NO: 1050 - DNA, 51 bp, Homo sapiens
  misc_feature (26)...(0): 2 of 2 allelic variants (1049 is other entry)
  misc_feature (0)...(0): Accession number cg44912347
tctttacattagagccaatttaagagggcgctggtatgtatgagctttttg

SEQ ID NO: 1051 - DNA, 51 bp, Homo sapiens
  misc_feature (26)...(0): 1 of 2 allelic variants (1052 is other entry)
  misc_feature (0)...(0): Accession number cg44913333
ctccccagaattcctagactgggttaatagggtcatattgtgaatgtctca

SEQ ID NO: 1052 - DNA, 51 bp, Homo sapiens
  misc_feature (26)...(0): 2 of 2 allelic variants (1051 is other entry)
  misc_feature (0)...(0): Accession number cg44913333
ctccccagaattcctagactgggttgatagggtcatattgtgaatgtctca

SEQ ID NO: 1053 - DNA, 51 bp, Homo sapiens
  misc_feature (26)...(0): 1 of 2 allelic variants (1054 is other entry)
  misc_feature (0)...(0): Accession number cg44914547
ggtccccctgcttcttccctgcagacatggtggagctgctgctgctgcaga

SEQ ID NO: 1054 - DNA, 51 bp, Homo sapiens
  misc_feature (26)...(0): 2 of 2 allelic variants (1053 is other entry)
  misc_feature (0)...(0): Accession number cg44914547
ggtccccctgcttcttccctgcagatatggtggagctgctgctgctgcaga

SEQ ID NO: 1055 - DNA, 51 bp, Homo sapiens
  misc_feature (26)...(0): 1 of 2 allelic variants (1056 is other entry)
  misc_feature (0)...(0): Accession number cg44914547
ggacctgcacagtgtacagacacacgtgttctctggtcctataatgctcta

SEQ ID NO: 1056 - DNA, 51 bp, Homo sapiens
  misc_feature (26)...(0): 2 of 2 allelic variants (1055 is other entry)
  misc_feature (0)...(0): Accession number cg44914547
ggacctgcacagtgtacagacacacctgttctctggtcctataatgctcta

SEQ ID NO: 1057 - DNA, 51 bp, Homo sapiens
  misc_feature (26)...(0): 1 of 2 allelic variants (1058 is other entry)
  misc_feature (0)...(0): Accession number cg44914864
gctccgatgcgcgatgcattcatagtgtcgcctttcaggaaagttcggtgt

SEQ ID NO: 1058 - DNA, 51 bp, Homo sapiens
  misc_feature (26)...(0): 2 of 2 allelic variants (1057 is other entry)
  misc_feature (0)...(0): Accession number cg44914864
gctccgatgcgcgatgcattcatagcgtcgcctttcaggaaagttcggtgt

SEQ ID NO: 1059 - DNA, 51 bp, Homo sapiens
  misc_feature (26)...(0): 1 of 2 allelic variants (1060 is other entry)
  misc_feature (0)...(0): Accession number cg44915149
gggtcatcgaccccattgatggcaccaagaacttcgtgcacgggtctgttg

SEQ ID NO: 1060 - DNA, 51 bp, Homo sapiens
  misc_feature (26)...(0): 2 of 2 allelic variants (1059 is other entry)
  misc_feature (0)...(0): Accession number cg44915149
gggtcatcgaccccattgatggcactaagaacttcgtgcacgggtctgttg

SEQ ID NO: 1061 - DNA, 51 bp, Homo sapiens
  misc_feature (26)...(0): 1 of 2 allelic variants (1062 is other entry)
  misc_feature (0)...(0): Accession number cg44916019
cccctacctggcctggctggccttcacgaccacactcaactactgcgtatg

SEQ ID NO: 1062 - DNA, 51 bp, Homo sapiens
  misc_feature (26)...(0): 2 of 2 allelic variants (1061 is other entry)
  misc_feature (0)...(0): Accession number cg44916019
cccctacctggcctggctggccttcgcgaccacactcaactactgcgtatg

SEQ ID NO: 1063 - DNA, 51 bp, Homo sapiens
  misc_feature (26)...(0): 1 of 2 allelic variants (1064 is other entry)
  misc_feature (0)...(0): Accession number cg44916367
ggtgccaccaggctctttttaacaaacagttctcacagaaactaatcaagt

SEQ ID NO: 1064 - DNA, 51 bp, Homo sapiens
  misc_feature (26)...(0): 2 of 2 allelic variants (1063 is other entry)
  misc_feature (0)...(0): Accession number cg44916367
ggtgccaccaggctctttttaacaagcagttctcacagaaactaatcaagt

SEQ ID NO: 1065 - DNA, 51 bp, Homo sapiens
  misc_feature (26)...(0): 1 of 2 allelic variants (1066 is other entry)
  misc_feature (0)...(0): Accession number cg44916367
agtgagaactcacttgttaccacaaagatggcaccaggctattcatgaagg

SEQ ID NO: 1066 - DNA, 51 bp, Homo sapiens
  misc_feature (26)...(0): 2 of 2 allelic variants (1065 is other entry)
  misc_feature (0)...(0): Accession number cg44916367
agtgagaactcacttgttaccacaaggatggcaccaggctattcatgaagg

SEQ ID NO: 1067 - DNA, 51 bp, Homo sapiens
  misc_feature (26)...(0): 1 of 2 allelic variants (1068 is other entry)
  misc_feature (0)...(0): Accession number cg44919480
gccacgaagtgattgtgtctgcagcatgtgggcggaaccacaccttggcct

SEQ ID NO: 1068 - DNA, 51 bp, Homo sapiens
  misc_feature (26)...(0): 2 of 2 allelic variants (1067 is other entry)
  misc_feature (0)...(0): Accession number cg44919480
gccacgaagtgattgtgtctgcagcgtgtgggcggaaccacaccttggcct

SEQ ID NO: 1069 - DNA, 51 bp, Homo sapiens
  misc_feature (26)...(0): 1 of 2 allelic variants (1070 is other entry)
  misc_feature (0)...(0): Accession number cg44919480
gatggggcagctgggccttggcaaccagacagacgctgttcccagccccgc

SEQ ID NO: 1070 - DNA, 51 bp, Homo sapiens
  misc_feature (26)...(0): 2 of 2 allelic variants (1069 is other entry)
  misc_feature (0)...(0): Accession number cg44919480
gatggggcagctgggccttggcaactagacagacgctgttcccagccccgc

SEQ ID NO: 1071 - DNA, 51 bp, Homo sapiens
  misc_feature (26)...(0): 1 of 2 allelic variants (1072 is other entry)
  misc_feature (0)...(0): Accession number cg44919623
gcccgctgcgatatgtcgtcctttgggaacctcagcagccagccgtaagtc

SEQ ID NO: 1072 - DNA, 51 bp, Homo sapiens
  misc_feature (26)...(0): 2 of 2 allelic variants (1071 is other entry)
  misc_feature (0)...(0): Accession number cg44919623
gcccgctgcgatatgtcgtcctttgagaacctcagcagccagccgtaagtc

SEQ ID NO: 1073 - DNA, 51 bp, Homo sapiens
  misc_feature (26)...(0): 1 of 2 allelic variants (1074 is other entry)
  misc_feature (0)...(0): Accession number cg44919623
ctgcgatatgtcgtcctttgggaacctcagcagccagccgtaagtcctcac

SEQ ID NO: 1074 - DNA, 51 bp, Homo sapiens
  misc_feature (26)...(0): 2 of 2 allelic variants (1073 is other entry)
  misc_feature (0)...(0): Accession number cg44919623
ctgcgatatgtcgtcctttgggaacttcagcagccagccgtaagtcctcac

SEQ ID NO: 1075 - DNA, 48 bp, Homo sapiens
  misc_feature (23)...(0): 1 of 2 allelic variants (1076 is other entry)
  misc_feature (0)...(0): Accession number cg44920877
acgcgttctgcgaggccatgcgggtctatgccccgcggccgttggcct

SEQ ID NO: 1076 - DNA, 48 bp, Homo sapiens
  misc_feature (23)...(0): 2 of 2 allelic variants (1075 is other entry)
  misc_feature (0)...(0): Accession number cg44920877
acgcgttctgcgaggccatgcgagtctatgccccgcggccgttggcct

SEQ ID NO: 1077 - DNA, 51 bp, Homo sapiens
  misc_feature (26)...(0): 1 of 2 allelic variants (1078 is other entry)
  misc_feature (0)...(0): Accession number cg44920877
cgcgttctgcgaggccatgcgggtctatgccccgcggccgttggcctcgcc

SEQ ID NO: 1078 - DNA, 51 bp, Homo sapiens
  misc_feature (26)...(0): 2 of 2 allelic variants (1077 is other entry)
  misc_feature (0)...(0): Accession number cg44920877
cgcgttctgcgaggccatgcgggtccatgccccgcggccgttggcctcgcc

SEQ ID NO: 1079 - DNA, 51 bp, Homo sapiens
  misc_feature (26)...(0): 1 of 2 allelic variants (1080 is other entry)
  misc_feature (0)...(0): Accession number cg44920877
gcgggtctatgccccgcggccgttggcctcgcccacacccccggccccact

SEQ ID NO: 1080 - DNA, 51 bp, Homo sapiens
  misc_feature (26)...(0): 2 of 2 allelic variants (1079 is other entry)
  misc_feature (0)...(0): Accession number cg44920877
gcgggtctatgccccgcggccgttgacctcgcccacacccccggccccact

SEQ ID NO: 1081 - DNA, 51 bp, Homo sapiens
  misc_feature (26)...(0): 1 of 2 allelic variants (1082 is other entry)
  misc_feature (0)...(0): Accession number cg44920877
ccgcggccgttggcctcgcccacacccccggccccactgcgggtggagaga

SEQ ID NO: 1082 - DNA, 51 bp, Homo sapiens
  misc_feature (26)...(0): 2 of 2 allelic variants (1081 is other entry)
  misc_feature (0)...(0): Accession number cg44920877
ccgcggccgttggcctcgcccacactcccggccccactgcgggtggagaga

SEQ ID NO: 1083 - DNA, 51 bp, Homo sapiens
  misc_feature (26)...(0): 1 of 2 allelic variants (1084 is other entry)
  misc_feature (0)...(0): Accession number cg44920877
tggcctcgcccacacccccggccccactgcgggtggagagacgtcgggccc

SEQ ID NO: 1084 - DNA, 51 bp, Homo sapiens
  misc_feature (26)...(0): 2 of 2 allelic variants (1083 is other entry)
  misc_feature (0)...(0): Accession number cg44920877
tggcctcgcccacacccccggccccgctgcgggtggagagacgtcgggccc

SEQ ID NO: 1085 - DNA, 51 bp, Homo sapiens
  misc_feature (26)...(0): 1 of 2 allelic variants (1086 is other entry)
  misc_feature (0)...(0): Accession number cg44923068
cggacacccggcgggagctggcggagctcgtgaagcggaagcaggagctgg

SEQ ID NO: 1086 - DNA, 50 bp, Homo sapiens
  misc_feature (26)...(0): 2 of 2 allelic variants (1085 is other entry)
  misc_feature (25)...(26): nucleotide deleted between bases 25 and 26
  misc_feature (0)...(0): Accession number cg44923068
cggacacccggcgggagctggcggactcgtgaagcggaagcaggagctgg

SEQ ID NO: 1087 - DNA, 51 bp, Homo sapiens
  misc_feature (26)...(0): 1 of 2 allelic variants (1088 is other entry)
  misc_feature (0)...(0): Accession number cg44928274
agcaaggggaagatcatcagcggcagcagcggcagcctgctgtcttcaggt

SEQ ID NO: 1088 - DNA, 50 bp, Homo sapiens
  misc_feature (26)...(0): 2 of 2 allelic variants (1087 is other entry)
  misc_feature (25)...(26): nucleotide deleted between bases 25 and 26
  misc_feature (0)...(0): Accession number cg44928274
agcaaggggaagatcatcagcggcacagcggcagcctgctgtcttcaggt

SEQ ID NO: 1089 - DNA, 51 bp, Homo sapiens
  misc_feature (26)...(0): 1 of 2 allelic variants (1090 is other entry)
  misc_feature (0)...(0): Accession number cg44928732
gtgtaccagcgcctgatccgggacattccctgccgcacggtcacgcctgac

SEQ ID NO: 1090 - DNA, 51 bp, Homo sapiens
  misc_feature (26)...(0): 2 of 2 allelic variants (1089 is other entry)
  misc_feature (0)...(0): Accession number cg44928732
gtgtaccagcgcctgatccgggacagtccctgccgcacggtcacgcctgac

SEQ ID NO: 1091 - DNA, 50 bp, Homo sapiens
  misc_feature (26)...(0): 1 of 2 allelic variants (1092 is other entry)
  misc_feature (25)...(26): nucleotide deleted between bases 25 and 26
  misc_feature (0)...(0): Accession number cg44932136
acagacgcgcacacacacgcgcacagacgcacacacagacgcacacacgc

SEQ ID NO: 1092 - DNA, 51 bp, Homo sapiens
  misc_feature (26)...(0): 2 of 2 allelic variants (1091 is other entry)
  misc_feature (0)...(0): Accession number cg44932136
acagacgcgcacacacacgcgcacacgacgcacacacagacgcacacacgc

SEQ ID NO: 1093 - DNA, 50 bp, Homo sapiens
  misc_feature (26)...(0): 1 of 2 allelic variants (1094 is other entry)
  misc_feature (25)...(26): nucleotide deleted between bases 25 and 26
  misc_feature (0)...(0): Accession number cg44932136
acacacgcgcacagacgcacacacagacgcacacacgcacagacacacac

SEQ ID NO: 1094 - DNA, 51 bp, Homo sapiens
  misc_feature (26)...(0): 2 of 2 allelic variants (1093 is other entry)
  misc_feature (0)...(0): Accession number cg44932136
acacacgcgcacagacgcacacacaagacgcacacacgcacagacacacac

SEQ ID NO: 1095 - DNA, 51 bp, Homo sapiens
  misc_feature (26)...(0): 1 of 2 allelic variants (1096 is other entry)
  misc_feature (0)...(0): Accession number cg44932184
tgggcacgagcgtggcttcggcggagcaggatgaactgtctcagagactgg

SEQ ID NO: 1096 - DNA, 50 bp, Homo sapiens
  misc_feature (26)...(0): 2 of 2 allelic variants (1095 is other entry)
  misc_feature (25)...(26): nucleotide deleted between bases 25 and 26
  misc_feature (0)...(0): Accession number cg44932184
tgggcacgagcgtggcttcggcggacaggatgaactgtctcagagactgg

SEQ ID NO: 1097 - DNA, 51 bp, Homo sapiens
  misc_feature (26)...(0): 1 of 2 allelic variants (1098 is other entry)
  misc_feature (0)...(0): Accession number cg44938456
tgaccttgaccagtttgatcagttactgcccacgctggagaaggcagcaca

SEQ ID NO: 1098 - DNA, 51 bp, Homo sapiens
  misc_feature (26)...(0): 2 of 2 allelic variants (1097 is other entry)
  misc_feature (0)...(0): Accession number cg44938456
tgaccttgaccagtttgatcagttattgcccacgctggagaaggcagcaca

SEQ ID NO: 1099 - DNA, 51 bp, Homo sapiens
  misc_feature (26)...(0): 1 of 2 allelic variants (1100 is other entry)
  misc_feature (0)...(0): Accession number cg44938456
tactgcccacgctggagaaggcagcacagttgccaggcttatgtgagacag

SEQ ID NO: 1100 - DNA, 51 bp, Homo sapiens
  misc_feature (26)...(0): 2 of 2 allelic variants (1099 is other entry)
  misc_feature (0)...(0): Accession number cg44938456
tactgcccacgctggagaaggcagcgcagttgccaggcttatgtgagacag

SEQ ID NO: 1101 - DNA, 51 bp, Homo sapiens
  misc_feature (26)...(0): 1 of 2 allelic variants (1102 is other entry)
  misc_feature (0)...(0): Accession number cg44938456
cgctggagaaggcagcacagttgccaggcttatgtgagacagacaggatgg

SEQ ID NO: 1102 - DNA, 51 bp, Homo sapiens
  misc_feature (26)...(0): 2 of 2 allelic variants (1101 is other entry)
  misc_feature (0)...(0): Accession number cg44938456
cgctggagaaggcagcacagttgccgggcttatgtgagacagacaggatgg

SEQ ID NO: 1103 - DNA, 51 bp, Homo sapiens
  misc_feature (26)...(0): 1 of 2 allelic variants (1104 is other entry)
  misc_feature (0)...(0): Accession number cg44938456
agaaggcagcacagttgccaggcttatgtgagacagacaggatggatggtg

SEQ ID NO: 1104 - DNA, 51 bp, Homo sapiens
  misc_feature (26)...(0): 2 of 2 allelic variants (1103 is other entry)
  misc_feature (0)...(0): Accession number cg44938456
agaaggcagcacagttgccaggcttgtgtgagacagacaggatggatggtg

SEQ ID NO: 1105 - DNA, 51 bp, Homo sapiens
  misc_feature (26)...(0): 1 of 2 allelic variants (1106 is other entry)
  misc_feature (0)...(0): Accession number cg44938456
gacagacaggatggatggtgcggtcaccagtgtaaccatcaaatcggagat

SEQ ID NO: 1106 - DNA, 51 bp, Homo sapiens
  misc_feature (26)...(0): 2 of 2 allelic variants (1105 is other entry)
  misc_feature (0)...(0): Accession number cg44938456
gacagacaggatggatggtgcggtccccagtgtaaccatcaaatcggagat

SEQ ID NO: 1107 - DNA, 51 bp, Homo sapiens
  misc_feature (26)...(0): 1 of 2 allelic variants (1108 is other entry)
  misc_feature (0)...(0): Accession number cg44938456
gtgcggtcaccagtgtaaccatcaaatcggagatcctgccagcttcacttc

SEQ ID NO: 1108 - DNA, 51 bp, Homo sapiens
  misc_feature (26)...(0): 2 of 2 allelic variants (1107 is other entry)
  misc_feature (0)...(0): Accession number cg44938456
gtgcggtcaccagtgtaaccatcaagtcggagatcctgccagcttcacttc

SEQ ID NO: 1109 - DNA, 51 bp, Homo sapiens
  misc_feature (26)...(0): 1 of 2 allelic variants (1110 is other entry)
  misc_feature (0)...(0): Accession number cg44938456
taaccatcaaatcggagatcctgccagcttcacttcagtccgccactgcca

SEQ ID NO: 1110 - DNA, 51 bp, Homo sapiens
  misc_feature (26)...(0): 2 of 2 allelic variants (1109 is other entry)
  misc_feature (0)...(0): Accession number cg44938456
taaccatcaaatcggagatcctgcccgcttcacttcagtccgccactgcca

SEQ ID NO: 1111 - DNA, 51 bp, Homo sapiens
  misc_feature (26)...(0): 1 of 2 allelic variants (1112 is other entry)
  misc_feature (0)...(0): Accession number cg5633308
acaaggggaacatcaacacaagagaagcctacaaagggcgagcgtgcaagc

SEQ ID NO: 1112 - DNA, 51 bp, Homo sapiens
  misc_feature (26)...(0): 2 of 2 allelic variants (1111 is other entry)
  misc_feature (0)...(0): Accession number cg5633308
acaaggggaacatcaacacaagagatgcctacaaagggcgagcgtgcaagc

SEQ ID NO: 1113 - DNA, 51 bp, Homo sapiens
  misc_feature (26)...(0): 1 of 2 allelic variants (1114 is other entry)
  misc_feature (0)...(0): Accession number cg32160481
gagatgggggtcatggcgccccgaaccctcctcctgctgctctcaggggcc

SEQ ID NO: 1114 - DNA, 51 bp, Homo sapiens
  misc_feature (26)...(0): 2 of 2 allelic variants (1113 is other entry)
  misc_feature (0)...(0): Accession number cg32160481
gagatgggggtcatggcgccccgaagcctcctcctgctgctctcaggggcc

SEQ ID NO: 1115 - DNA, 51 bp, Homo sapiens
  misc_feature (26)...(0): 1 of 2 allelic variants (1116 is other entry)
  misc_feature (0)...(0): Accession number cg32160481
tctcaggggccctggccctgaccgagacctgggcgggtgagtgcggggtcg

SEQ ID NO: 1116 - DNA, 51 bp, Homo sapiens
  misc_feature (26)...(0): 2 of 2 allelic variants (1115 is other entry)
  misc_feature (0)...(0): Accession number cg32160481
tctcaggggccctggccctgaccgatacctgggcgggtgagtgcggggtcg

SEQ ID NO: 1117 - DNA, 51 bp, Homo sapiens
  misc_feature (26)...(0): 1 of 2 allelic variants (1118 is other entry)
  misc_feature (0)...(0): Accession number cg27790564
agcttgagcagagccttgaccttctacacacaaactgttagtgtcggtgtt

SEQ ID NO: 1118 - DNA, 51 bp, Homo sapiens
  misc_feature (26)...(0): 2 of 2 allelic variants (1117 is other entry)
  misc_feature (0)...(0): Accession number cg27790564
agcttgagcagagccttgaccttctgcacacaaactgttagtgtcggtgtt

SEQ ID NO: 1119 - DNA, 51 bp, Homo sapiens
  misc_feature (26)...(0): 1 of 2 allelic variants (1120 is other entry)
  misc_feature (0)...(0): Accession number cg43967452
gcgttaccggctgcagcggcgggaggactacacgcgctacaaccagctgag

SEQ ID NO: 1120 - DNA, 51 bp, Homo sapiens
  misc_feature (26)...(0): 2 of 2 allelic variants (1119 is other entry)
  misc_feature (0)...(0): Accession number cg43967452
gcgttaccggctgcagcggcgggagaactacacgcgctacaaccagctgag

SEQ ID NO: 1121 - DNA, 51 bp, Homo sapiens
  misc_feature (26)...(0): 1 of 2 allelic variants (1122 is other entry)
  misc_feature (0)...(0): Accession number cg39548335
tgtattctcgttgttaccggcggccttcctgggagtgctcattattcattt

SEQ ID NO: 1122 - DNA, 51 bp, Homo sapiens
  misc_feature (26)...(0): 2 of 2 allelic variants (1121 is other entry)
  misc_feature (0)...(0): Accession number cg39548335
tgtattctcgttgttaccggcggccctcctgggagtgctcattattcattt

SEQ ID NO: 1123 - DNA, 51 bp, Homo sapiens
  misc_feature (26)...(0): 1 of 2 allelic variants (1124 is other entry)
  misc_feature (0)...(0): Accession number cg38435145
tgctggagaatttggccacaaagagctgccaagatagctgggccaggaaga

SEQ ID NO: 1124 - DNA, 51 bp, Homo sapiens
  misc_feature (26)...(0): 2 of 2 allelic variants (1123 is other entry)
  misc_feature (0)...(0): Accession number cg38435145
tgctggagaatttggccacaaagagttgccaagatagctgggccaggaaga

SEQ ID NO: 1125 - DNA, 51 bp, Homo sapiens
  misc_feature (26)...(0): 1 of 2 allelic variants (1126 is other entry)
  misc_feature (0)...(0): Accession number cg42894694
ttttgtatttttagtagagacggggtttcaccatgttggccaggctggtct

SEQ ID NO: 1126 - DNA, 51 bp, Homo sapiens
  misc_feature (26)...(0): 2 of 2 allelic variants (1125 is other entry)
  misc_feature (0)...(0): Accession number cg42894694
ttttgtatttttagtagagacggggcttcaccatgttggccaggctggtct

SEQ ID NO: 1127 - DNA, 51 bp, Homo sapiens
  misc_feature (26)...(0): 1 of 2 allelic variants (1128 is other entry)
  misc_feature (0)...(0): Accession number cg27847601
tgaggtgggaggactgcctgaaccaaggaggtggaggctgcagtgagccaa

SEQ ID NO: 1128 - DNA, 51 bp, Homo sapiens
  misc_feature (26)...(0): 2 of 2 allelic variants (1127 is other entry)
  misc_feature (0)...(0): Accession number cg27847601
tgaggtgggaggactgcctgaaccagggaggtggaggctgcagtgagccaa

SEQ ID NO: 1129 - DNA, 51 bp, Homo sapiens
  misc_feature (26)...(0): 1 of 2 allelic variants (1130 is other entry)
  misc_feature (0)...(0): Accession number cg43976973
gtgagcatcatgatgctgctgtcggcttcggggggcagcacgtccaccagt

SEQ ID NO: 1130 - DNA, 51 bp, Homo sapiens
  misc_feature (26)...(0): 2 of 2 allelic variants (1129 is other entry)
  misc_feature (0)...(0): Accession number cg43976973
gtgagcatcatgatgctgctgtcgggttcggggggcagcacgtccaccagt

SEQ ID NO: 1131 - DNA, 51 bp, Homo sapiens
  misc_feature (26)...(0): 1 of 2 allelic variants (1132 is other entry)
  misc_feature (0)...(0): Accession number cg43925450
gcaactggtgctccaggccgaaaccgaggtgtggacctccaggagaacaac

SEQ ID NO: 1132 - DNA, 51 bp, Homo sapiens
  misc_feature (26)...(0): 2 of 2 allelic variants (1131 is other entry)
  misc_feature (0)...(0): Accession number cg43925450
gcaactggtgctccaggccgaaacctaggtgtggacctccaggagaacaac

SEQ ID NO: 1133 - DNA, 51 bp, Homo sapiens
  misc_feature (26)...(0): 1 of 2 allelic variants (1134 is other entry)
  misc_feature (0)...(0): Accession number cg43305492
ctccaaaaaccaggtggtccttacaatgaccaacatggaccctgtggacac

SEQ ID NO: 1134 - DNA, 51 bp, Homo sapiens
  misc_feature (26)...(0): 2 of 2 allelic variants (1133 is other entry)
  misc_feature (0)...(0): Accession number cg43305492
ctccaaaaaccaggtggtccttacactgaccaacatggaccctgtggacac

SEQ ID NO: 1135 - DNA, 51 bp, Homo sapiens
  misc_feature (26)...(0): 1 of 2 allelic variants (1136 is other entry)
  misc_feature (0)...(0): Accession number cg34758710
gggcatcattgctggcctggttgtccttgcagctgtagtcactggagctgc

SEQ ID NO: 1136 - DNA, 51 bp, Homo sapiens
  misc_feature (26)...(0): 2 of 2 allelic variants (1135 is other entry)
  misc_feature (0)...(0): Accession number cg34758710
gggcatcattgctggcctggttgtctttgcagctgtagtcactggagctgc

SEQ ID NO: 1137 - DNA, 51 bp, Homo sapiens
  misc_feature (26)...(0): 1 of 2 allelic variants (1138 is other entry)
  misc_feature (0)...(0): Accession number cg43923640
tccgctgaggaaattcaagctggtgttcctgggggagcaaagcgttggaaa

SEQ ID NO: 1138 - DNA, 51 bp, Homo sapiens
  misc_feature (26)...(0): 2 of 2 allelic variants (1137 is other entry)
  misc_feature (0)...(0): Accession number cg43923640
tccgctgaggaaattcaagctggtgctcctgggggagcaaagcgttggaaa

SEQ ID NO: 1139 - DNA, 40 bp, Homo sapiens
  misc_feature (15)...(0): 1 of 2 allelic variants (1140 is other entry)
  misc_feature (0)...(0): Accession number cg27790564
ggtaccacagatagcaatggagccggagaccttgttaaca

SEQ ID NO: 1140 - DNA, 40 bp, Homo sapiens
  misc_feature (15)...(0): 2 of 2 allelic variants (1139 is other entry)
  misc_feature (0)...(0): Accession number cg27790564
ggtaccacagatagtaatggagccggagaccttgttaaca

SEQ ID NO: 1141 - DNA, 51 bp, Homo sapiens
  misc_feature (26)...(0): 1 of 2 allelic variants (1142 is other entry)
  misc_feature (0)...(0): Accession number cg39517733
ccctcatcaaagatgggggctgttggtgggcacttggggtagcagccttcc

SEQ ID NO: 1142 - DNA, 51 bp, Homo sapiens
  misc_feature (26)...(0): 2 of 2 allelic variants (1141 is other entry)
  misc_feature (0)...(0): Accession number cg39517733
ccctcatcaaagatgggggctgttgatgggcacttggggtagcagccttcc

SEQ ID NO: 1143 - DNA, 51 bp, Homo sapiens
  misc_feature (26)...(0): 1 of 2 allelic variants (1144 is other entry)
  misc_feature (0)...(0): Accession number cg39517733
ccagcatcatgggtacagttcacactactctccgtacaaacgcaggaataa

SEQ ID NO: 1144 - DNA, 51 bp, Homo sapiens
  misc_feature (26)...(0): 2 of 2 allelic variants (1143 is other entry)
  misc_feature (0)...(0): Accession number cg39517733
ccagcatcatgggtacagttcacaccactctccgtacaaacgcaggaataa

SEQ ID NO: 1145 - DNA, 51 bp, Homo sapiens
  misc_feature (26)...(0): 1 of 2 allelic variants (1146 is other entry)
  misc_feature (0)...(0): Accession number cg39565684
ttctgggataaggtattggtaccatcgggaatcgcacgcggatctagcatt

SEQ ID NO: 1146 - DNA, 51 bp, Homo sapiens
  misc_feature (26)...(0): 2 of 2 allelic variants (1145 is other entry)
  misc_feature (0)...(0): Accession number cg39565684
ttctgggataaggtattggtaccattgggaatcgcacgcggatctagcatt

SEQ ID NO: 1147 - DNA, 51 bp, Homo sapiens
  misc_feature (26)...(0): 1 of 2 allelic variants (1148 is other entry)
  misc_feature (0)...(0): Accession number cg32152874
caaggtgtacgtgtccatgccggccatggccatgcacctgctcacgcacga

SEQ ID NO: 1148 - DNA, 51 bp, Homo sapiens
  misc_feature (26)...(0): 2 of 2 allelic variants (1147 is other entry)
  misc_feature (0)...(0): Accession number cg32152874
caaggtgtacgtgtccatgccggccctggccatgcacctgctcacgcacga

SEQ ID NO: 1149 - DNA, 51 bp, Homo sapiens
  misc_feature (26)...(0): 1 of 2 allelic variants (1150 is other entry)
  misc_feature (0)...(0): Accession number cg43025141
ctacgccaagcgcaacgccctgcgcgccgccgaggtgtggatggatgactt

SEQ ID NO: 1150 - DNA, 51 bp, Homo sapiens
  misc_feature (26)...(0): 2 of 2 allelic variants (1149 is other entry)
  misc_feature (0)...(0): Accession number cg43025141
ctacgccaagcgcaacgccctgcgcaccgccgaggtgtggatggatgactt

SEQ ID NO: 1151 - DNA, 51 bp, Homo sapiens
  misc_feature (26)...(0): 1 of 2 allelic variants (1152 is other entry)
  misc_feature (0)...(0): Accession number cg44028935
ggcaggatgatcaagctgttctcgctgaagcagcagaagaaggaggaggag

SEQ ID NO: 1152 - DNA, 51 bp, Homo sapiens
  misc_feature (26)...(0): 2 of 2 allelic variants (1151 is other entry)
  misc_feature (0)...(0): Accession number cg44028935
ggcaggatgatcaagctgttctcgcagaagcagcagaagaaggaggaggag

SEQ ID NO: 1153 - DNA, 51 bp, Homo sapiens
  misc_feature (26)...(0): 1 of 2 allelic variants (1154 is other entry)
  misc_feature (0)...(0): Accession number cg44028935
caggatgatcaagctgttctcgctgaagcagcagaagaaggaggaggagtc

SEQ ID NO: 1154 - DNA, 51 bp, Homo sapiens
  misc_feature (26)...(0): 2 of 2 allelic variants (1153 is other entry)
  misc_feature (0)...(0): Accession number cg44028935
caggatgatcaagctgttctcgctgcagcagcagaagaaggaggaggagtc

SEQ ID NO: 1155 - DNA, 51 bp, Homo sapiens
  misc_feature (26)...(0): 1 of 2 allelic variants (1156 is other entry)
  misc_feature (0)...(0): Accession number cg44028935
aggatgatcaagctgttctcgctgaagcagcagaagaaggaggaggagtcg

SEQ ID NO: 1156 - DNA, 51 bp, Homo sapiens
  misc_feature (26)...(0): 2 of 2 allelic variants (1155 is other entry)
  misc_feature (0)...(0): Accession number cg44028935
aggatgatcaagctgttctcgctgatgcagcagaagaaggaggaggagtcg

SEQ ID NO: 1157 - DNA, 51 bp, Homo sapiens
  misc_feature (26)...(0): 1 of 2 allelic variants (1158 is other entry)
  misc_feature (0)...(0): Accession number cg44028935
atgatcaagctgttctcgctgaagcagcagaagaaggaggaggagtcggcg

SEQ ID NO: 1158 - DNA, 51 bp, Homo sapiens
  misc_feature (26)...(0): 2 of 2 allelic variants (1157 is other entry)
  misc_feature (0)...(0): Accession number cg44028935
atgatcaagctgttctcgctgaagcggcagaagaaggaggaggagtcggcg

SEQ ID NO: 1159 - DNA, 51 bp, Homo sapiens
  misc_feature (26)...(0): 1 of 2 allelic variants (1160 is other entry)
  misc_feature (0)...(0): Accession number cg39548335
atcagtacctcatccttgagacgttgttcttcaagggctctctcccgaaag

SEQ ID NO: 1160 - DNA, 51 bp, Homo sapiens
  misc_feature (26)...(0): 2 of 2 allelic variants (1159 is other entry)
  misc_feature (0)...(0): Accession number cg39548335
atcagtacctcatccttgagacgttattcttcaagggctctctcccgaaag

SEQ ID NO: 1161 - DNA, 51 bp, Homo sapiens
  misc_feature (26)...(0): 1 of 2 allelic variants (1162 is other entry)
  misc_feature (0)...(0): Accession number cg39548335
tcatctattagattccgtgcttgagttttattagtagttgtatcgttgcct

SEQ ID NO: 1162 - DNA, 51 bp, Homo sapiens
  misc_feature (26)...(0): 2 of 2 allelic variants (1161 is other entry)
  misc_feature (0)...(0): Accession number cg39548335
tcatctattagattccgtgcttgagctttattagtagttgtatcgttgcct

SEQ ID NO: 1163 - DNA, 51 bp, Homo sapiens
  misc_feature (26)...(0): 1 of 2 allelic variants (1164 is other entry)
  misc_feature (0)...(0): Accession number cg39510144
attgggttgtatgcagaactctatccatgcggggaatgttcatatcacttt

SEQ ID NO: 1164 - DNA, 51 bp, Homo sapiens
  misc_feature (26)...(0): 2 of 2 allelic variants (1163 is other entry)
  misc_feature (0)...(0): Accession number cg39510144
attgggttgtatgcagaactctatctatgcggggaatgttcatatcacttt

SEQ ID NO: 1165 - DNA, 51 bp, Homo sapiens
  misc_feature (26)...(0): 1 of 2 allelic variants (1166 is other entry)
  misc_feature (0)...(0): Accession number cg39565075
cggagaagaggagtcactgcacgtgtttcagtatgctaatagaccaaggct

SEQ ID NO: 1166 - DNA, 51 bp, Homo sapiens
  misc_feature (26)...(0): 2 of 2 allelic variants (1165 is other entry)
  misc_feature (0)...(0): Accession number cg39565075
cggagaagaggagtcactgcacgtggttcagtatgctaatagaccaaggct

SEQ ID NO: 1167 - DNA, 51 bp, Homo sapiens
  misc_feature (26)...(0): 1 of 2 allelic variants (1168 is other entry)
  misc_feature (0)...(0): Accession number cg21427396
tcaaacccatggtcgagagtgggagcgttatgccatggttaaagcccgtgt

SEQ ID NO: 1168 - DNA, 51 bp, Homo sapiens
  misc_feature (26)...(0): 2 of 2 allelic variants (1167 is other entry)
  misc_feature (0)...(0): Accession number cg21427396
tcaaacccatggtcgagagtgggagtgttatgccatggttaaagcccgtgt

SEQ ID NO: 1169 - DNA, 51 bp, Homo sapiens
  misc_feature (26)...(0): 1 of 2 allelic variants (1170 is other entry)
  misc_feature (0)...(0): Accession number cg34394308
gttgatgctgctcagccggcgcacggcacgcctccagaattgtgctactcg

SEQ ID NO: 1170 - DNA, 51 bp, Homo sapiens
  misc_feature (26)...(0): 2 of 2 allelic variants (1169 is other entry)
  misc_feature (0)...(0): Accession number cg34394308
gttgatgctgctcagccggcgcacgacacgcctccagaattgtgctactcg

SEQ ID NO: 1171 - DNA, 51 bp, Homo sapiens
  misc_feature (26)...(0): 1 of 2 allelic variants (1172 is other entry)
  misc_feature (0)...(0): Accession number cg43129081
cctcgatctcctgacctcgtgatccgcccaccttggcctcccaaagtgctg

SEQ ID NO: 1172 - DNA, 51 bp, Homo sapiens
  misc_feature (26)...(0): 2 of 2 allelic variants (1171 is other entry)
  misc_feature (0)...(0): Accession number cg43129081
cctcgatctcctgacctcgtgatccacccaccttggcctcccaaagtgctg

SEQ ID NO: 1173 - DNA, 51 bp, Homo sapiens
  misc_feature (26)...(0): 1 of 2 allelic variants (1174 is other entry)
  misc_feature (0)...(0): Accession number cg29693502
ctgatcgacgtattccaacagctcattcgtcaactcccggtcgccggcacc

SEQ ID NO: 1174 - DNA, 51 bp, Homo sapiens
  misc_feature (26)...(0): 2 of 2 allelic variants (1173 is other entry)
  misc_feature (0)...(0): Accession number cg29693502
ctgatcgacgtattccaacagctcagtcgtcaactcccggtcgccggcacc

SEQ ID NO: 1175 - DNA, 51 bp, Homo sapiens
  misc_feature (26)...(0): 1 of 2 allelic variants (1176 is other entry)
  misc_feature (0)...(0): Accession number cg27850036
taggtgtctagccagtccatgtcaccgtagacgtcctcggagtagaggtga

SEQ ID NO: 1176 - DNA, 51 bp, Homo sapiens
  misc_feature (26)...(0): 2 of 2 allelic variants (1175 is other entry)
  misc_feature (0)...(0): Accession number cg27850036
taggtgtctagccagtccatgtcactgtagacgtcctcggagtagaggtga

SEQ ID NO: 1177 - DNA, 51 bp, Homo sapiens
  misc_feature (26)...(0): 1 of 2 allelic variants (1178 is other entry)
  misc_feature (0)...(0): Accession number cg43936560
ttgggcagcttatctgtgtgcccaggcggcatatctgtgcatgtgcgtgtg

SEQ ID NO: 1178 - DNA, 51 bp, Homo sapiens
  misc_feature (26)...(0): 2 of 2 allelic variants (1177 is other entry)
  misc_feature (0)...(0): Accession number cg43936560
ttgggcagcttatctgtgtgcccagccggcatatctgtgcatgtgcgtgtg

SEQ ID NO: 1179 - DNA, 51 bp, Homo sapiens
  misc_feature (26)...(0): 1 of 2 allelic variants (1180 is other entry)
  misc_feature (0)...(0): Accession number cg42538578
gcagcacttggccttccctctgtaacaggtgccttgaattttggtaaagat

SEQ ID NO: 1180 - DNA, 51 bp, Homo sapiens
  misc_feature (26)...(0): 2 of 2 allelic variants (1179 is other entry)
  misc_feature (0)...(0): Accession number cg42538578
gcagcacttggccttccctctgtaataggtgccttgaattttggtaaagat

SEQ ID NO: 1181 - DNA, 51 bp, Homo sapiens
  misc_feature (26)...(0): 1 of 2 allelic variants (1182 is other entry)
  misc_feature (0)...(0): Accession number cg42475469
ctgacctcaagtgatccacctgcctcagcctcccaaagtgctgggattaca

SEQ ID NO: 1182 - DNA, 51 bp, Homo sapiens
  misc_feature (26)...(0): 2 of 2 allelic variants (1181 is other entry)
  misc_feature (0)...(0): Accession number cg42475469
ctgacctcaagtgatccacctgccttagcctcccaaagtgctgggattaca

SEQ ID NO: 1183 - DNA, 51 bp, Homo sapiens
  misc_feature (26)...(0): 1 of 2 allelic variants (1184 is other entry)
  misc_feature (0)...(0): Accession number cg27847601
ctgaggtgggaggactgcctgaaccaaggaggtggaggctgcagtgagcca

SEQ ID NO: 1184 - DNA, 51 bp, Homo sapiens
  misc_feature (26)...(0): 2 of 2 allelic variants (1183 is other entry)
  misc_feature (0)...(0): Accession number cg27847601
ctgaggtgggaggactgcctgaaccgaggaggtggaggctgcagtgagcca

SEQ ID NO: 1185 - DNA, 51 bp, Homo sapiens
  misc_feature (26)...(0): 1 of 2 allelic variants (1186 is other entry)
  misc_feature (0)...(0): Accession number cg27847601
ctgaaccaaggaggtggaggctgcagtgagccaagatcacagcactatgct

SEQ ID NO: 1186 - DNA, 51 bp, Homo sapiens
  misc_feature (26)...(0): 2 of 2 allelic variants (1185 is other entry)
  misc_feature (0)...(0): Accession number cg27847601
ctgaaccaaggaggtggaggctgcaatgagccaagatcacagcactatgct

SEQ ID NO: 1187 - DNA, 51 bp, Homo sapiens
  misc_feature (26)...(0): 1 of 2 allelic variants (1188 is other entry)
  misc_feature (0)...(0): Accession number cg44931270
cggcgccgggaggctgtgggtctggctgcgcacggtctcggtcagcagagc

SEQ ID NO: 1188 - DNA, 50 bp, Homo sapiens
  misc_feature (26)...(0): 2 of 2 allelic variants (1187 is other entry)
  misc_feature (25)...(26): nucleotide deleted between bases 25 and 26
  misc_feature (0)...(0): Accession number cg44931270
cggcgccgggaggctgtgggtctggtgcgcacggtctcggtcagcagagc

SEQ ID NO: 1189 - DNA, 50 bp, Homo sapiens
  misc_feature (26)...(0): 1 of 2 allelic variants (1190 is other entry)
  misc_feature (25)...(26): nucleotide deleted between bases 25 and 26
  misc_feature (0)...(0): Accession number cg43925450
gatctgtcaatttaagctggttctgctgggggagtctgcggtaggcaaat

SEQ ID NO: 1190 - DNA, 51 bp, Homo sapiens
  misc_feature (26)...(0): 2 of 2 allelic variants (1189 is other entry)
  misc_feature (0)...(0): Accession number cg43925450
gatctgtcaatttaagctggttctgtctgggggagtctgcggtaggcaaat

SEQ ID NO: 1191 - DNA, 50 bp, Homo sapiens
  misc_feature (26)...(0): 1 of 2 allelic variants (1192 is other entry)
  misc_feature (25)...(26): nucleotide deleted between bases 25 and 26
  misc_feature (0)...(0): Accession number cg43941918
cagccacagttcgtttgatctccaccttggtcccttggccgaaagtgcgc

SEQ ID NO: 1192 - DNA, 51 bp, Homo sapiens
  misc_feature (26)...(0): 2 of 2 allelic variants (1191 is other entry)
  misc_feature (0)...(0): Accession number cg43941918
cagccacagttcgtttgatctccactcttggtcccttggccgaaagtgcgc

SEQ ID NO: 1193 - protein, 14 aa, Homo sapiens
  VARIANT (7)...(0): cSNP translation
  misc_feature (0)...(0): Peptide 1 of 2 allelic variants (1194 is other peptide)
GVMAPRTLLLLLSG

SEQ ID NO: 1194 - protein, 14 aa, Homo sapiens
  VARIANT (7)...(0): cSNP translation
  misc_feature (0)...(0): Peptide 2 of 2 allelic variants (1193 is other peptide)
GVMAPRSLLLLLSG

SEQ ID NO: 1195 - protein, 10 aa, Homo sapiens
  VARIANT (7)...(0): cSNP translation
  misc_feature (0)...(0): Peptide 1 of 2 allelic variants (1196 is other peptide)
GALALTETWA

SEQ ID NO: 1196 - protein, 10 aa, Homo sapiens
  VARIANT (7)...(0): cSNP translation
  misc_feature (0)...(0): Peptide 2 of 2 allelic variants (1195 is other peptide)
GALALTDTWA

SEQ ID NO: 1197 - protein, 14 aa, Homo sapiens
  VARIANT (7)...(0): cSNP translation
  misc_feature (0)...(0): Peptide 1 of 2 allelic variants (1198 is other peptide)
DTNSLCVEGQGSAQ

SEQ ID NO: 1198 - protein, 14 aa, Homo sapiens
  VARIANT (7)...(0): cSNP translation
  misc_feature (0)...(0): Peptide 2 of 2 allelic variants (1197 is other peptide)
DTNSLCAEGQGSAQ

SEQ ID NO: 1199 - protein, 14 aa, Homo sapiens
  VARIANT (7)...(0): cSNP translation
  misc_feature (0)...(0): Peptide 1 of 2 allelic variants (1200 is other peptide)
RLQRREDYTRYNQL

SEQ ID NO: 1200 - protein, 14 aa, Homo sapiens
  VARIANT (7)...(0): cSNP translation
  misc_feature (0)...(0): Peptide 2 of 2 allelic variants (1199 is other peptide)
RLQRRENYTRYNQL

SEQ ID NO: 1201 - protein, 14 aa, Homo sapiens
  VARIANT (7)...(0): cSNP translation
  misc_feature (0)...(0): Peptide 1 of 2 allelic variants (1202 is other peptide)
IMSTPRKAAGNNEN

SEQ ID NO: 1202 - protein, 14 aa, Homo sapiens
  VARIANT (7)...(0): cSNP translation
  misc_feature (0)...(0): Peptide 2 of 2 allelic variants (1201 is other peptide)
IMSTPRRAAGNNEN

SEQ ID NO: 1203 - protein, 14 aa, Homo sapiens
  VARIANT (7)...(0): cSNP translation
  misc_feature (0)...(0): Peptide 1 of 2 allelic variants (1204 is other peptide)
RIWPQRAAKIAGPG

SEQ ID NO: 1204 - protein, 14 aa, Homo sapiens
  VARIANT (7)...(0): cSNP translation
  misc_feature (0)...(0): Peptide 2 of 2 allelic variants (1203 is other peptide)
RIWPQRVAKIAGPG

SEQ ID NO: 1205 - protein, 14 aa, Homo sapiens
  VARIANT (7)...(0): cSNP translation
  misc_feature (0)...(0): Peptide 1 of 2 allelic variants (1206 is other peptide)
IFSRDGVSPCWPGW

SEQ ID NO: 1206 - protein, 14 aa, Homo sapiens
  VARIANT (7)...(0): cSNP translation
  misc_feature (0)...(0): Peptide 2 of 2 allelic variants (1205 is other peptide)
IFSRDGASPCWPGW

SEQ ID NO: 1207 - protein, 4 aa, Homo sapiens
  VARIANT (7)...(0): cSNP translation
  misc_feature (0)...(0): Peptide 1 of 2 allelic variants (1208 is other peptide)
GRTA

SEQ ID NO: 1208 - protein, 4 aa, Homo sapiens
  VARIANT (7)...(0): cSNP translation
  misc_feature (0)...(0): Peptide 2 of 2 allelic variants (1207 is other peptide)
GRTA

SEQ ID NO: 1209 - protein, 12 aa, Homo sapiens
  VARIANT (7)...(0): cSNP translation
  misc_feature (0)...(0): Peptide 1 of 2 allelic variants (1210 is other peptide)
WTCCPPKPTAAS

SEQ ID NO: 1210 - protein, 12 aa, Homo sapiens
  VARIANT (7)...(0): cSNP translation
  misc_feature (0)...(0): Peptide 2 of 2 allelic variants (1209 is other peptide)
WTCCPPNPTAAS

SEQ ID NO: 1211 - protein, 14 aa, Homo sapiens
  VARIANT (7)...(0): cSNP translation
  misc_feature (0)...(0): Peptide 1 of 2 allelic variants (1212 is other peptide)
GAPGRNRGVDLQEN

SEQ ID NO: 1212 - protein, 14 aa, Homo sapiens
  VARIANT (7)...(0): cSNP translation
  misc_feature (0)...(0): Peptide 2 of 2 allelic variants (1211 is other peptide)
GAPGRNLGVDLQEN

SEQ ID NO: 1213 - protein, 14 aa, Homo sapiens
  VARIANT (7)...(0): cSNP translation
  misc_feature (0)...(0): Peptide 1 of 2 allelic variants (1214 is other peptide)
NQVVLTMTNMDPVD

SEQ ID NO: 1214 - protein, 14 aa, Homo sapiens
  VARIANT (7)...(0): cSNP translation
  misc_feature (0)...(0): Peptide 2 of 2 allelic variants (1213 is other peptide)
NQVVLTLTNMDPVD

SEQ ID NO: 1215 - protein, 14 aa, Homo sapiens
  VARIANT (7)...(0): cSNP translation
  misc_feature (0)...(0): Peptide 1 of 2 allelic variants (1216 is other peptide)
IAGLVVLAAVVTGA

SEQ ID NO: 1216 - protein, 14 aa, Homo sapiens
  VARIANT (7)...(0): cSNP translation
  misc_feature (0)...(0): Peptide 2 of 2 allelic variants (1215 is other peptide)
IAGLVVFAAVVTGA

SEQ ID NO: 1217 - protein, 14 aa, Homo sapiens
  VARIANT (7)...(0): cSNP translation
  misc_feature (0)...(0): Peptide 1 of 2 allelic variants (1218 is other peptide)
RKFKLVFLGEQSVG

SEQ ID NO: 1218 - protein, 14 aa, Homo sapiens
  VARIANT (7)...(0): cSNP translation
  misc_feature (0)...(0): Peptide 2 of 2 allelic variants (1217 is other peptide)
RKFKLVLLGEQSVG

SEQ ID NO: 1219 - protein, 10 aa, Homo sapiens
  VARIANT (7)...(0): cSNP translation
  misc_feature (0)...(0): Peptide 1 of 2 allelic variants (1220 is other peptide)
KVSGSIAICG

SEQ ID NO: 1220 - protein, 10 aa, Homo sapiens
  VARIANT (7)...(0): cSNP translation
  misc_feature (0)...(0): Peptide 2 of 2 allelic variants (1219 is other peptide)
KVSGSITICG

SEQ ID NO: 1221 - protein, 14 aa, Homo sapiens
  VARIANT (7)...(0): cSNP translation
  misc_feature (0)...(0): Peptide 1 of 2 allelic variants (1222 is other peptide)
CYPKCPPTAPIFDE

SEQ ID NO: 1222 - protein, 14 aa, Homo sapiens
  VARIANT (7)...(0): cSNP translation
  misc_feature (0)...(0): Peptide 2 of 2 allelic variants (1221 is other peptide)
CYPKCPSTAPIFDE

SEQ ID NO: 1223 - protein, 14 aa, Homo sapiens
  VARIANT (7)...(0): cSNP translation
  misc_feature (0)...(0): Peptide 1 of 2 allelic variants (1224 is other peptide)
CVCTESSVNCTHDA

SEQ ID NO: 1224 - protein, 14 aa, Homo sapiens
  VARIANT (7)...(0): cSNP translation
  misc_feature (0)...(0): Peptide 2 of 2 allelic variants (1223 is other peptide)
CVCTESGVNCTHDA

SEQ ID NO: 1225 - protein, 14 aa, Homo sapiens
  VARIANT (7)...(0): cSNP translation
  misc_feature (0)...(0): Peptide 1 of 2 allelic variants (1226 is other peptide)
RSACDSRWYQYLIP

SEQ ID NO: 1226 - protein, 14 aa, Homo sapiens
  VARIANT (7)...(0): cSNP translation
  misc_feature (0)...(0): Peptide 2 of 2 allelic variants (1225 is other peptide)
RSACDSQWYQYLIP

SEQ ID NO: 1227 - protein, 14 aa, Homo sapiens
  VARIANT (7)...(0): cSNP translation
  misc_feature (0)...(0): Peptide 1 of 2 allelic variants (1228 is other peptide)
YVSMPAMAMHLLTH

SEQ ID NO: 1228 - protein, 14 aa, Homo sapiens
  VARIANT (7)...(0): cSNP translation
  misc_feature (0)...(0): Peptide 2 of 2 allelic variants (1227 is other peptide)
YVSMPALAMHLLTH

SEQ ID NO: 1229 - protein, 14 aa, Homo sapiens
  VARIANT (7)...(0): cSNP translation
  misc_feature (0)...(0): Peptide 1 of 2 allelic variants (1230 is other peptide)
KRNALRAAEVWMDD

SEQ ID NO: 1230 - protein, 14 aa, Homo sapiens
  VARIANT (7)...(0): cSNP translation
  misc_feature (0)...(0): Peptide 2 of 2 allelic variants (1229 is other peptide)
KRNALRTAEVWMDD

SEQ ID NO: 1231 - protein, 14 aa, Homo sapiens
  VARIANT (7)...(0): cSNP translation
  misc_feature (0)...(0): Peptide 1 of 2 allelic variants (1232 is other peptide)
MIKLFSLKQQKKEE

SEQ ID NO: 1232 - protein, 14 aa, Homo sapiens
  VARIANT (7)...(0): cSNP translation
  misc_feature (0)...(0): Peptide 2 of 2 allelic variants (1231 is other peptide)
MIKLFSQKQQKKEE

SEQ ID NO: 1233 - protein, 14 aa, Homo sapiens
  VARIANT (7)...(0): cSNP translation
  misc_feature (0)...(0): Peptide 1 of 2 allelic variants (1234 is other peptide)
IKLFSLKQQKKEEE

SEQ ID NO: 1234 - protein, 14 aa, Homo sapiens
  VARIANT (7)...(0): cSNP translation
  misc_feature (0)...(0): Peptide 2 of 2 allelic variants (1233 is other peptide)
IKLFSLQQQKKEEE

SEQ ID NO: 1235 - protein, 14 aa, Homo sapiens
  VARIANT (7)...(0): cSNP translation
  misc_feature (0)...(0): Peptide 1 of 2 allelic variants (1236 is other peptide)
IKLFSLKQQKKEEE

SEQ ID NO: 1236 - protein, 14 aa, Homo sapiens
  VARIANT (7)...(0): cSNP translation
  misc_feature (0)...(0): Peptide 2 of 2 allelic variants (1235 is other peptide)
IKLFSLMQQKKEEE

SEQ ID NO: 1237 - protein, 14 aa, Homo sapiens
  VARIANT (7)...(0): cSNP translation
  misc_feature (0)...(0): Peptide 1 of 2 allelic variants (1238 is other peptide)
KLFSLKQQKKEEES

SEQ ID NO: 1238 - protein, 14 aa, Homo sapiens
  VARIANT (7)...(0): cSNP translation
  misc_feature (0)...(0): Peptide 2 of 2 allelic variants (1237 is other peptide)
KLFSLKRQKKEEES

SEQ ID NO: 1239 - protein, 14 aa, Homo sapiens
  VARIANT (7)...(0): cSNP translation
  misc_feature (0)...(0): Peptide 1 of 2 allelic variants (1240 is other peptide)
ERALEEQRLKDEVL

SEQ ID NO: 1240 - protein, 6 aa, Homo sapiens
  VARIANT (7)...(0): cSNP translation
  misc_feature (0)...(0): Peptide 2 of 2 allelic variants (1239 is other peptide)
ERALEE

SEQ ID NO: 1241 - protein, 14 aa, Homo sapiens
  VARIANT (7)...(0): cSNP translation
  misc_feature (0)...(0): Peptide 1 of 2 allelic variants (1242 is other peptide)
DTTTNKTQARNLID

SEQ ID NO: 1242 - protein, 14 aa, Homo sapiens
  VARIANT (7)...(0): cSNP translation
  misc_feature (0)...(0): Peptide 2 of 2 allelic variants (1241 is other peptide)
DTTTNKAQARNLID

SEQ ID NO: 1243 - protein, 14 aa, Homo sapiens
  VARIANT (7)...(0): cSNP translation
  misc_feature (0)...(0): Peptide 1 of 2 allelic variants (1244 is other peptide)
LYAELYPCGECSYH

SEQ ID NO: 1244 - protein, 14 aa, Homo sapiens
  VARIANT (7)...(0): cSNP translation
  misc_feature (0)...(0): Peptide 2 of 2 allelic variants (1243 is other peptide)
LYAELYLCGECSYH

SEQ ID NO: 1245 - protein, 14 aa, Homo sapiens
  VARIANT (7)...(0): cSNP translation
  misc_feature (0)...(0): Peptide 1 of 2 allelic variants (1246 is other peptide)
EESLHVFQYANRPR

SEQ ID NO: 1246 - protein, 14 aa, Homo sapiens
  VARIANT (7)...(0): cSNP translation
  misc_feature (0)...(0): Peptide 2 of 2 allelic variants (1245 is other peptide)
EESLHVVQYANRPR

SEQ ID NO: 1247 - protein, 14 aa, Homo sapiens
  VARIANT (7)...(0): cSNP translation
  misc_feature (0)...(0): Peptide 1 of 2 allelic variants (1248 is other peptide)
HGREWERYAMVKAR

SEQ ID NO: 1248 - protein, 14 aa, Homo sapiens
  VARIANT (7)...(0): cSNP translation
  misc_feature (0)...(0): Peptide 2 of 2 allelic variants (1247 is other peptide)
HGREWECYAMVKAR

SEQ ID NO: 1249 - protein, 14 aa, Homo sapiens
  VARIANT (7)...(0): cSNP translation
  misc_feature (0)...(0): Peptide 1 of 2 allelic variants (1250 is other peptide)
AAQPAHGTPPELCY

SEQ ID NO: 1250 - protein, 14 aa, Homo sapiens
  VARIANT (7)...(0): cSNP translation
  misc_feature (0)...(0): Peptide 2 of 2 allelic variants (1249 is other peptide)
AAQPAHDTPPELCY

SEQ ID NO: 1251 - protein, 4 aa, Homo sapiens
  VARIANT (7)...(0): cSNP translation
  misc_feature (0)...(0): Peptide 1 of 2 allelic variants (1252 is other peptide)
LLTS

SEQ ID NO: 1252 - protein, 4 aa, Homo sapiens
  VARIANT (7)...(0): cSNP translation
  misc_feature (0)...(0): Peptide 2 of 2 allelic variants (1251 is other peptide)
LLTS

SEQ ID NO: 1253 - protein, 14 aa, Homo sapiens
  VARIANT (7)...(0): cSNP translation
  misc_feature (0)...(0): Peptide 1 of 2 allelic variants (1254 is other peptide)
GDRELTNELLEYVD

SEQ ID NO: 1254 - protein, 14 aa, Homo sapiens
  VARIANT (7)...(0): cSNP translation
  misc_feature (0)...(0): Peptide 2 of 2 allelic variants (1253 is other peptide)
GDRELTTELLEYVD

SEQ ID NO: 1255 - protein, 14 aa, Homo sapiens
  VARIANT (7)...(0): cSNP translation
  misc_feature (0)...(0): Peptide 1 of 2 allelic variants (1256 is other peptide)
YSEDVYGDMDWLDT

SEQ ID NO: 1256 - protein, 14 aa, Homo sapiens
  VARIANT (7)...(0): cSNP translation
  misc_feature (0)...(0): Peptide 2 of 2 allelic variants (1255 is other peptide)
YSEDVYSDMDWLDT

SEQ ID NO: 1257 - protein, 14 aa, Homo sapiens
  VARIANT (7)...(0): cSNP translation
  misc_feature (0)...(0): Peptide 1 of 2 allelic variants (1258 is other peptide)
AYLCAQAAYLCMCV

SEQ ID NO: 1258 - protein, 14 aa, Homo sapiens
  VARIANT (7)...(0): cSNP translation
  misc_feature (0)...(0): Peptide 2 of 2 allelic variants (1257 is other peptide)
AYLCAQPAYLCMCV

SEQ ID NO: 1259 - protein, 14 aa, Homo sapiens
  VARIANT (7)...(0): cSNP translation
  misc_feature (0)...(0): Peptide 1 of 2 allelic variants (1260 is other peptide)
TKIQGTCYRGKAKC

SEQ ID NO: 1260 - protein, 14 aa, Homo sapiens
  VARIANT (7)...(0): cSNP translation
  misc_feature (0)...(0): Peptide 2 of 2 allelic variants (1259 is other peptide)
TKIQGTYYRGKAKC

SEQ ID NO: 1261 - protein, 14 aa, Homo sapiens
  VARIANT (7)...(0): cSNP translation
  misc_feature (0)...(0): Peptide 1 of 2 allelic variants (1262 is other peptide)
PALWEAEAGGSLEV

SEQ ID NO: 1262 - protein, 14 aa, Homo sapiens
  VARIANT (7)...(0): cSNP translation
  misc_feature (0)...(0): Peptide 2 of 2 allelic variants (1261 is other peptide)
PALWEAKAGGSLEV

SEQ ID NO: 1263 - protein, 4 aa, Homo sapiens
  VARIANT (7)...(0): cSNP translation
  misc_feature (0)...(0): Peptide 1 of 2 allelic variants (1264 is other peptide)
GRTA

SEQ ID NO: 1264 - protein, 4 aa, Homo sapiens
  VARIANT (7)...(0): cSNP translation
  misc_feature (0)...(0): Peptide 2 of 2 allelic variants (1263 is other peptide)
GRTA

SEQ ID NO: 1265 - protein, 14 aa, Homo sapiens
  VARIANT (7)...(0): cSNP translation
  misc_feature (0)...(0): Peptide 1 of 2 allelic variants (1266 is other peptide)
KEVEAAVSQDHSTM

SEQ ID NO: 1266 - protein, 14 aa, Homo sapiens
  VARIANT (7)...(0): cSNP translation
  misc_feature (0)...(0): Peptide 2 of 2 allelic variants (1265 is other peptide)
KEVEAAMSQDHSTM

SEQ ID NO: 1267 - protein, 14 aa, Homo sapiens
  VARIANT (7)...(0): cSNP translation
  misc_feature (0)...(0): Peptide 1 of 2 allelic variants (1268 is other peptide)
ADRDRAQPDPQPPG

SEQ ID NO: 1268 - protein, 14 aa, Homo sapiens
  VARIANT (7)...(0): cSNP translation
  misc_feature (0)...(0): Peptide 2 of 2 allelic variants (1267 is other peptide)
ADRDRAHQTHSLPA

SEQ ID NO: 1269 - protein, 14 aa, Homo sapiens
  VARIANT (8)...(0): cSNP translation
  misc_feature (0)...(0): Peptide 1 of 2 allelic variants (1270 is other peptide)
CQFKLVLLGESAVG

SEQ ID NO: 1270 - protein, 14 aa, Homo sapiens
  VARIANT (8)...(0): cSNP translation
  misc_feature (0)...(0): Peptide 2 of 2 allelic variants (1269 is other peptide)
CQFKLVLSGGVCGR

SEQ ID NO: 1271 - protein, 10 aa, Homo sapiens
  VARIANT (7)...(0): cSNP translation
  misc_feature (0)...(0): Peptide 1 of 2 allelic variants (1272 is other peptide)
FGQGTKVEIK

SEQ ID NO: 1272 - protein, 10 aa, Homo sapiens
  VARIANT (7)...(0): cSNP translation
  misc_feature (0)...(0): Peptide 2 of 2 allelic variants (1271 is other peptide)
FGQGTKSGDQ

What is claimed is:

1. An isolated polynucleotide consisting of the polymorphic nucleotide sequence of SEQ ID NO: 1142.

2. An isolated allele-specific oligonucleotide that hybridizes to a first polynucleotide at a polymorphic site encompassed therein, wherein the first polynucleotide comprises the polymorphic nucleotide sequence of SEQ ID NO: 1142.

3. An isolated nucleic acid molecule of between 10 and 50 bases of which at least 10 contiguous bases are from SEQ ID NO: 1141 wherein said isolated nucleic acid molecule comprises the nucleotide corresponding to position 26 of SEQ ID NO: 1141 wherein said nucleotide is not a guanosine.

4. The isolated nucleic acid molecule of claim 3, wherein the nucleotide at position 26 is an adenosine.

5. An isolated nucleic acid molecule consisting of a sequence complementary to the isolated nucleic acid molecule of claim 3.

6. An isolated nucleic acid molecule of between 10 and 50 bases of which at least 10 contiguous bases are from SEQ ID NO: 1144 wherein said isolated nucleic acid molecule comprises the nucleotide corresponding to position 26 of SEQ ID NO: 1144 wherein said nucleotide is not a cytosine.

7. The isolated nucleic acid molecule of claim 6, wherein the nucleotide at position 26 is a thymidine.

8. An isolated nucleic acid molecule consisting of a sequence complementary to the isolated nucleic acid molecule of claim 6.

9. An isolated nucleic acid molecule of between 10 and 50 bases of which at least 10 contiguous bases are from SEQ ID NO: 1149 wherein said isolated nucleic acid molecule comprises the nucleotide corresponding to position 26 of SEQ ID NO: 1149 wherein said nucleotide is not a guanosine.

10. The isolated nucleic acid molecule of claim 9, wherein the nucleotide at position 26 is an adenosine.

11. An isolated nucleic acid molecule consisting of a sequence complementary to the isolated nucleic acid molecule of claim 9.

12. An isolated nucleic acid molecule of between 10 and 50 bases of which at least 10 contiguous bases are from SEQ ID NO: 1179 wherein said isolated nucleic acid molecule comprises the nucleotide corresponding to position 26 of SEQ ID NO: 1179 wherein said nucleotide is not a cytosine.

13. The isolated nucleic acid molecule of claim 12, wherein the nucleotide at position 26 is a thymidine.

14. An isolated nucleic acid molecule consisting of a sequence complementary to the isolated nucleic acid molecule of claim 12.

15. An isolated nucleic acid molecule consisting of between 10–50 contiguous bases from SEQ ID NO: 1141 wherein said isolated nucleic acid molecule comprises the nucleotide at position 26 of SEQ ID NO: 1141 wherein nucleotide is not a guanosine, and wherein said isolated nucleic acid molecule encodes a polypeptide which has gastric mucin activity.

16. The isolated nucleic acid molecule of claim 15, wherein the nucleotide at position 26 is an adenosine.

17. An isolated nucleic acid molecule consisting of between 10–50 contiguous bases from SEQ ID NO: 1144 wherein said isolated nucleic acid molecule comprises the nucleotide at position 26 of SEQ ID NO: 1144 wherein said nucleotide is not a cytosine, and wherein said isolated nucleic acid molecule encodes a polypeptide which has gastric mucin activity.

18. The isolated nucleic acid molecule of claim 17, wherein the nucleotide at position 26 is an thymidine.

19. An isolated nucleic acid molecule consisting of between 10–50 contiguous bases from SEQ ID NO: 1149 in which the nucleotide at position 26 is not a guanosine, wherein said isolated nucleic acid molecule encodes a polypeptide which has N-acetylgalactosaminyltransferase (GALNAC transferase) activity.

20. An isolated nucleic acid molecule consisting of between 10–50 contiguous bases from SEQ ID NO: 1149 wherein said isolated nucleic acid molecule comprises the nucleotide at position 26 of SEQ ID NO: 1149 wherein said nucleotide is not a guanosine, and wherein said isolated nucleic acid molecule encodes a polypeptide which has N-acetylgalactosaminyltransferase (GALNAC transferase) activity.

21. An isolated nucleic acid molecule consisting of between 10–50 contiguous bases from SEQ ID NO: 1179 wherein said isolated nucleic acid molecule comprises the nucleotide at position 26 of SEQ ID NO: 1179 wherein said nucleotide is not a cytosine, and wherein said isolated nucleic acid molecule encodes a polypeptide which has defensin beta 1 (DEFB1) activity.

22. The isolated nucleic acid molecule of claim 21, wherein the nucleotide at position 26 is an thymidine.

23. An isolated polynucleotide consisting of a polymorphic nucleotide sequence of SEQ ID NO: 1143.

24. An isolated polynucleotide consisting of a polymorphic nucleotide sequence of SEQ ID NO: 1150.

25. An isolated polynucleotide consisting of a polymorphic nucleotide sequence of SEQ ID NO: 1180.

26. An isolated allele-specific oligonucleotide that hybridizes to a first polynucleotide at a polymorphic site encompassed therein, wherein the first polynucleotide comprises the polymorphic nucleotide sequence of SEQ ID NO: 1143.

27. An isolated allele-specific oligonucleotide that hybridizes to a first polynucleotide at a polymorphic site encompassed therein, wherein the first polynucleotide comprises the polymorphic nucleotide sequence of SEQ ID NO: 1150.

28. An isolated allele-specific oligonucleotide that hybridizes to a first polynucleotide at a polymorphic site encompassed therein, wherein the first polynucleotide comprises the polymorphic nucleotide sequence of SEQ ID NO: 1180.

* * * * *